(12) United States Patent
Nelles et al.

(10) Patent No.: US 10,822,617 B2
(45) Date of Patent: *Nov. 3, 2020

(54) RNA-TARGETING FUSION PROTEIN COMPOSITIONS AND METHODS FOR USE

(71) Applicant: Locana, Inc., San Diego, CA (US)

(72) Inventors: David A. Nelles, San Diego, CA (US); Ranjan Batra, San Diego, CA (US); Eugene Yeo, San Diego, CA (US)

(73) Assignee: Locana, Inc., San Diego, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/723,079

(22) Filed: Dec. 20, 2019

(65) Prior Publication Data
US 2020/0123569 A1    Apr. 23, 2020

Related U.S. Application Data

(63) Continuation of application No. 16/434,689, filed on Jun. 7, 2019.

(60) Provisional application No. 62/682,271, filed on Jun. 8, 2018.

(51) Int. Cl.
| | |
|---|---|
| *C12N 15/85* | (2006.01) |
| *C12N 9/22* | (2006.01) |
| *C12N 15/11* | (2006.01) |
| *C12N 15/90* | (2006.01) |
| *C12N 15/63* | (2006.01) |

(52) U.S. Cl.
CPC .............. *C12N 15/85* (2013.01); *C12N 9/22* (2013.01); *C12N 15/11* (2013.01); *C12N 15/63* (2013.01); *C12N 15/907* (2013.01); *C07K 2319/85* (2013.01); *C12N 2310/20* (2017.05)

(58) Field of Classification Search
CPC ............................... C07K 2319/85; C12N 9/22
See application file for complete search history.

(56) References Cited

U.S. PATENT DOCUMENTS

| | | | |
|---|---|---|---|
| 2013/0129701 A1* | 5/2013 | Wang et al. | C12N 9/22 424/94.3 |
| 2013/0178513 A1 | 7/2013 | Dobie et al. | |
| 2016/0238593 A1 | 8/2016 | Boyden et al. | |
| 2017/0088845 A1 | 3/2017 | Ryan et al. | |
| 2017/0145394 A1 | 5/2017 | Yeo et al. | |
| 2017/0314002 A1 | 11/2017 | Gong | |
| 2019/0062724 A1 | 2/2019 | Hsu et al. | |
| 2019/0382759 A1 | 12/2019 | Nelles et al. | |

FOREIGN PATENT DOCUMENTS

| | | | |
|---|---|---|---|
| WO | WO 2012/068627 A1 | 5/2012 | |
| WO | WO 2013/058404 A1 | 4/2013 | |
| WO | WO 2015/089486 A2 | 6/2015 | |
| WO | WO 2016/196655 A1 | 12/2016 | |
| WO | WO 2017/091630 A1 | 6/2017 | |
| WO | WO 2017/093969 A1 | 6/2017 | |
| WO | WO 2018/081806 A2 | 5/2018 | |
| WO | WO 2018/170333 A1 | 9/2018 | |
| WO | WO 2018/183703 A1 | 10/2018 | |
| WO | WO 2019/006471 A2 | 1/2019 | |
| WO | WO 2019/040664 A1 | 2/2019 | |

OTHER PUBLICATIONS

Filipovska et al. A universal code for RNA recognition by PUF proteins. Nature Chemical Biology, vol. 7, pp. 425-427, May 15, 2011. (Year: 2011).*
Adamala et al. Programmable RNA-bindign protein composed of repeats of a single modular unit. Proceedings of the National Academy of Sciences of the USA, vol. 113, No. 19, pp. E2579-2588, Apr. 26, 2016, including pp. 1/89-89/89 of Supporting Materials. (Year: 2016).*
Filipovska et al. Modular recognition of nucleic acids by PUF, tALE and PPR proteins. Molecular BioSystems, vol. 8, pp. 699-708, 2012. (Year: 2012).*
Jeltsch et al. Cleavage of roquin and regnase-1 by the paracaspase MALT1 releases their cooperatively repressed targets to promote TH17 differentiation. Nature Immunology, vol. 15, No. 11, pp. 1079-1089, Oct. 5, 2014, including pp. 1/2-2/2 of Online Methods, and pp. 1/8-8/8 of Supplementary Information. (Year: 2014).* Zhou et al. Monocyte chemoattractant protein-1 induces a novel transcription factor that causes cardiac myocyte apoptosis and ventricular dysfunction. Circulation Research, vol. 98, pp. 1177-1185, Mar. 2006. (Year: 2006).*
GenBank Accession No. AY920403.1, printed as pp. 1/2-2/2, Jun. 2008. (Year: 2008).*
Uehata et al. mRNA degradation by the endoribonuclease Regnase-1/ZC3H12a/MCPIP-1. Biochimica et Biophysica Acta, vol. 1829, pp. 708-713, 2013. (Year: 2013).*
Matsushita et al. Zc3h12a is an RNase essential for controlling immune responses by regulating mRNA decay. Nature, vol. 458, pp. 1185-1190, Mar. 25, 2009, including pp. 1/2-2/2 of Methods. (Year: 2009).*
Wilamowski et al. Substrate specificity of human MCPIP1 endoribonuclease. Scientific Reports, vol. 8: 7381, May 9, 2018, printed as pp. 1-14, including pp. 1-12 of Supplementary Data. (Year: 2018).*

(Continued)

*Primary Examiner* — Jennifer Dunston
(74) *Attorney, Agent, or Firm* — Cooley LLP

(57) ABSTRACT

Disclosed are compositions comprising: a sequence encoding a fusion protein, the sequence comprising a sequence encoding a first RNA-binding polypeptide and a sequence encoding a second RNA-binding polypeptide, wherein neither the first RNA-binding polypeptide nor the second RNA-binding polypeptide comprises a significant DNA-nuclease activity, wherein the first RNA-binding polypeptide and the second RNA-binding polypeptide are not identical, and wherein the second RNA-binding polypeptide comprises an RNA-nuclease activity. Methods of making and methods of using compositions of the disclosure are also provided. For example, compositions of the disclosure may be used in the treatment of a disease or disorder in a subject. Exemplary disease or disorders of the disclosure include genetic and epigenetic diseases or disorders.

11 Claims, 13 Drawing Sheets
(9 of 13 Drawing Sheet(s) Filed in Color)
Specification includes a Sequence Listing.

(56) References Cited

OTHER PUBLICATIONS

Cox, D. B. T. et al., "RNA editing with CRISPR-Cas13," Science, 358:1019-1027 (2017).
Durand, S. & Cimarelli, A., "The Inside Out of Lentiviral Vectors," Viruses, 3:132-159 (2011); doi:10.3390/v3020132.
Konermann, S. et al., "Transcriptome Engineering with RNA-Targeting Type VI-D CRISPR Effectors," Cell, 173:665-676 (2018), and Methods, 14 pages.
O'Connell, M. R. et al., "Programmable RNA recognition and cleavage by CRISPR/Cas9," Nature, 516:263-266 and Methods, 10 pages. (2014).
Wang, Y. et al., "Engineering splicing factors with designed specificities," Nature Methods, 6(11):825-830 (2009), and Online Methods, 2 pages.
Yan, W. X. et al., "Cas13d Is a Compact RNA-Targeting Type VI CRISPR Effector Positively Modulated by a WYL-Domain-Containing Accessory Protein," Molecular Cell, 70:327-339 (2018), and Methods, 5 pages.
Batra, R. et al., "Elimination of Toxic Microsatellite Repeat Expansion RNA by RNA-Targeting Cas9," Cell, 170(5):899-912 (2017), including Methods and Supplemental Figures, 10 pages.
Nowak, C. M. et al., "Guide RNA engineering for versatile Cas9 functionality," Nucleic Acids Res, 44(20):9555-9564 (2016).
Wang, M. et al., "The PUF Protein Family: Overview on PUF RNA Targets, Biological Functions, and Post Transcriptional Regulation," Int. J. Mol. Sci., 19:410 (2018), 13 pages; https://www.ncbi.nlm.nih.gov/pmc/articles/PMC5855632/.
Zhang, W. et al., "Treatment of type 1 myotonic dystrophy by engineering site-specific RNA endonucleases that target (CUG)n repeats," Mol Ther, 22(2):312-320 (2014).

\* cited by examiner

High expression positive control: "pos control"

Two plasmid system with PIN-SpyCas9 driven by a highly-active CMV promoter. This promoter is 5-20x as active as EFS.

Low expression positive control: "P13"

Single plasmid system with lower expression of the fusion. Same architecture as the fusions involving new endonucleases

FIG. 6

Endonuclease Name Key

| ID | Name |
|---|---|
| E1 | RNAse1 |
| E2 | RNAse4 |
| E3 | RNAse6 |
| E4 | NOB1 |
| E5 | EndoV |
| E6 | FEN1 |
| E7 | SLFN14 |
| E8 | LACTB2 |
| E9 | RNAse7 |
| E10 | RNAse8 |
| E11 | RNAse2 |
| E12 | ANG |
| E13 | HRSP12 |
| E14 | RNAse6PL |
| E15 | RNAseL |
| E16 | RNAseT2 |
| E17 | ZC3H12A |
| E37 | RIDA |
| E39 | RNAse11 |
| E41 | PD16 |
| E43 | NTHL1 |
| E45 | KIAA0391 |
| E47 | APEX1 |
| E49 | Ago2 |
| E51 | ZC3H12A |
| E53 | EXOG |
| E55 | ZC3H12D |
| E57 | EBN2 |
| E59 | ENDOG |
| E61 | PELO |
| E63 | YBEY |
| E65 | ENDOD1 |
| E67 | CPSF4L |
| E69 | hCG_2002731 |
| E71 | hCG_2002731 |
| E73 | ERCC1 |
| E75 | RAC1 |
| E77 | APEX2 |
| E79 | APEX2_1-350 |
| E81 | RAA1_25-156 |
| E83 | RAB1 |
| E85 | RNAseK |
| E87 | DNA2_FL |
| E89 | RNASE1(K41R) |
| E91 | RNASE1(K41R, D121E) |
| E93 | RNASE1(K41R, D121E, H119N) |
| E95 | RNASE1(H119N) |
| E97 | RNASE1(R39D, N67D, N88A, G89D, R91D, H119N) |
| E99 | RNASE1(R39D, N67D, N88A, G89D, R91D, H119N, K41R, D121E) |
| E100 | RNAse1 (R39D, N67D, N88A, G89D, R91D, H119N, K41R, D121E) |
| E101 | RNASE1(R39D, N67D, N88A, G89D, R91D) |

FIG. 7B

Zika NS5 protein knockdown with RCas9

RNA-TARGETING FUSION PROTEIN COMPOSITIONS AND METHODS FOR USE

RELATED APPLICATIONS

This is a continuation of U.S. Ser. No. 16/434,689, filed Jun. 7, 2019, which claims priority to U.S. Patent Application No. 62/682,271, filed Jun. 8, 2018, the contents of each are herein incorporated by reference in their entirety. The contents of U.S. Patent Application No. 62/682,276, filed Jun. 8, 2018, are herein incorporated by reference in their entirety.

FIELD OF THE DISCLOSURE

The disclosure is directed to molecular biology, and more, specifically, to compositions and methods for modifying expression and activity of RNA molecules.

INCORPORATION OF SEQUENCE LISTING

The contents of the text file named "LOCN-002_C01US_SeqList.txt", which was created on Dec. 17, 2019 and is 774 KB in size, are hereby incorporated by reference in their entirety. BACKGROUND There has been a long-felt but unmet need in the art for a method of specifically binding target RNA molecules for modification of expression or activity of the RNA molecule or a protein encoded by the RNA molecule. The disclosure provides compositions and methods for specifically targeting RNA molecules in sequence-specific manner that further precludes modification of DNA sequences.

SUMMARY

The disclosure provides a composition comprising (a) a sequence comprising a guide RNA (gRNA) that specifically binds a target sequence within an RNA molecule and (b) a sequence encoding a fusion protein, the sequence comprising a sequence encoding a first RNA-binding polypeptide and a sequence encoding a second RNA-binding polypeptide, wherein neither the first RNA-binding polypeptide nor the second RNA-binding polypeptide comprises a significant DNA-nuclease activity, wherein the first RNA-binding polypeptide and the second RNA-binding polypeptide are not identical, and wherein the second RNA-binding polypeptide comprises an RNA-nuclease activity wherein the first RNA-binding polypeptide and the second RNA-binding polypeptide are not identical, and wherein the second RNA-binding polypeptide comprises an RNA-nuclease activity.

The disclosure also provides a composition comprising a sequence encoding an RNA-guided target RNA-binding fusion protein comprising (a) a sequence encoding a first RNA-binding polypeptide or portion thereof; and (b) a sequence encoding a second RNA-binding polypeptide, wherein the first RNA-binding polypeptide binds a target RNA guided by a gRNA sequence, and wherein the second RNA-binding polypeptide comprises RNA-nuclease activity.

The disclosure additionally provides a composition comprising a sequence encoding a target RNA-binding fusion protein comprising (a) a sequence encoding a first RNA-binding polypeptide or portion thereof; and (b) a sequence encoding a second RNA-binding polypeptide, wherein the first RNA-binding polypeptide binds a target RNA without a gRNA sequence, and wherein the second RNA-binding polypeptide comprises RNA-nuclease activity.

In some embodiments of the compositions of the disclosure, the target sequence comprises at least one repeated sequence.

In some embodiments of the compositions of the disclosure, the sequence comprising the gRNA further comprises a sequence encoding a promoter capable of expressing the gRNA in a eukaryotic cell.

In some embodiments of the compositions of the disclosure, the eukaryotic cell is an animal cell. In some embodiments, the animal cell is a mammalian cell. In some embodiments, the animal cell is a human cell.

In some embodiments of the compositions of the disclosure, the promoter is a constitutively active promoter. In some embodiments, the promoter sequence is isolated or derived from a promoter capable of driving expression of an RNA polymerase. In some embodiments, the promoter sequence is isolated or derived from a U6 promoter. In some embodiments, the promoter is a sequence isolated or derived from a promoter capable of driving expression of a transfer RNA (tRNA). In some embodiments, the promoter is isolated or derived from an alanine tRNA promoter, an arginine tRNA promoter, an asparagine tRNA promoter, an aspartic acid tRNA promoter, a cysteine tRNA promoter, a glutamine tRNA promoter, a glutamic acid tRNA promoter, a glycine tRNA promoter, a histidine tRNA promoter, an isoleucine tRNA promoter, a leucine tRNA promoter, a lysine tRNA promoter, a methionine tRNA promoter, a phenylalanine tRNA promoter, a proline tRNA promoter, a serine tRNA promoter, a threonine tRNA promoter, a tryptophan tRNA promoter, a tyrosine tRNA promoter, or a valine tRNA promoter. In some embodiments, the promoter is isolated or derived from a valine tRNA promoter.

In some embodiments of the compositions of the disclosure, the sequence comprising the gRNA further comprises a spacer sequence that specifically binds to the target RNA sequence. In some embodiments, the spacer sequence has at least 50%, 55%, 60%, 65%, 70%, 75%, 80%, 87%, 90%, 95%, 97%, 99% or any percentage in between of complementarity to the target RNA sequence. In some embodiments, the spacer sequence has 100% complementarity to the target RNA sequence. In some embodiments, the spacer sequence comprises or consists of 20 nucleotides. In some embodiments, the spacer sequence comprises or consists of 21 nucleotides. In some embodiments, the spacer sequence comprises or consists of the sequence

```
                                        (SEQ ID NO: 1)
UGGAGCGAGCAUCCCCCAAA, (SEQ ID NO: 2)
GUUUGGGGGAUGCUCGCUCCA, (SEQ ID NO: 3)
CCCUCACUGCUGGGGAGUCC, (SEQ ID NO: 4)
GGACUCCCCAGCAGUGAGGG, (SEQ ID NO: 5)
GCAACUGGAUCAAUUUGCUG, (SEQ ID NO: 6)
GCAGCAAAUUGAUCCAGUUGC, (SEQ ID NO: 7)
GCAUUCUUAUCUGGUCAGUGC, (SEQ ID NO: 8)
GCACUGACCAGAUAAGAAUG,
```

-continued

GAGCAGCAGCAGCAGCAGCAG, (SEQ ID NO: 9)

GCAGGCAGGCAGGCAGGCAGG, (SEQ ID NO: 10)

GCCCCGGCCCCGGCCCCGGC, or (SEQ ID NO: 11)

GCTGCTGCTGCTGCTGCTGC, (SEQ ID NO: 12)

GGGGCCGGGGCCGGGGCCGG, (SEQ ID NO: 74)

GGGCCGGGGCCGGGGCCGGG, (SEQ ID NO: 75)

GGCCGGGGCCGGGGCCGGGG, (SEQ ID NO: 76)

GCCGGGGCCGGGGCCGGGGC, (SEQ ID NO: 77)

CCGGGGCCGGGGCCGGGGCC, or (SEQ ID NO: 78)

CGGGGCCGGGGCCGGGGCCG. (SEQ ID NO: 79)

In some embodiments of the compositions of the disclosure, the sequence comprising the gRNA further comprises a spacer sequence that specifically binds to the target RNA sequence. In some embodiments, the spacer sequence has at least 50%, 55%, 60%, 65%, 70%, 75%, 80%, 87%, 90%, 95%, 97%, 99% or any percentage in between of complementarity to the target RNA sequence.

In some embodiments, the spacer sequence has 100% complementarity to the target RNA sequence. In some embodiments, the spacer sequence comprises or consists of 20 nucleotides. In some embodiments, the spacer sequence comprises or consists of 21 nucleotides. In some embodiments, the spacer sequence comprises or consists of the sequence

GUGAUAAGUGGAAUGCCAUG, (SEQ ID NO: 14)

CUGGUGAACUUCCGAUAGUG, or (SEQ ID NO: 15)

GAGATATAGCCTGGTGGTTC. (SEQ ID NO: 16)

In some embodiments of the compositions of the disclosure, the sequence comprising the gRNA further comprises a spacer sequence that specifically binds to the target RNA sequence. In some embodiments, the spacer sequence has at least 50%, 55%, 60%, 65%, 70%, 75%, 80%, 87%, 90%, 95%, 97%, 99% or any percentage in between of complementarity to the target RNA sequence. In some embodiments, the spacer sequence has 100% complementarity to the target RNA sequence. In some embodiments, the spacer sequence comprises or consists of 20 nucleotides. In some embodiments, the spacer sequence comprises or consists of 21 nucleotides. In some embodiments, the spacer sequence comprises or consists of a sequence comprising at least 1, 2, 3, 4, 5, 6, or 7 repeats of the sequence CUG (SEQ ID NO: 18), CCUG (SEQ ID NO: 19), CAG (SEQ ID NO: 80), GGGGCC (SEQ ID NO: 81) or any combination thereof.

In some embodiments of the compositions of the disclosure, the sequence comprising the gRNA further comprises a scaffold sequence that specifically binds to the first RNA binding protein. In some embodiments, the scaffold sequence comprises a stem-loop structure. In some embodiments, the scaffold sequence comprises or consists of 90 nucleotides. In some embodiments, the scaffold sequence comprises or consists of 93 nucleotides. In some embodiments, the scaffold sequence comprises or consists of the sequence GUUUAAGAGCUAUGCUGGAAACAGCAU-AGCAAGUUUAAAUAAGGCUAGUCCGUU AUCAAC-UUGAAAAAGUGGCACCGAGUCGGUGCUUUUUUU (SEQ ID NO: 13). In some embodiments, the scaffold sequence comprises or consists of the sequence GGACA-GCAUAGCAAGUUAAAAUAAGGCUAGUCCGUUAU-CAACUUGAAAAAGUGG CACCGAGUCGGUGCUU-UUU (SEQ ID NO: 17). In some embodiments, the scaffold sequence comprises or consists of the sequence (SEQ ID NO: 82)
GUUUAAGAGCUAUGCUGGAAACAGCAUAGCAAGUUUAAAUAAGGCUAGUCC

GUUAUCAACUUGAAAAAGUGGCACCGAGUCGGUGCUUUUUUU or (SEQ ID NO: 83)
GUUUUAGAGCUAGAAAUAGCAAGUUAAAAUAAGGCUAGUCCGUUAUCAACU

UGAAAAAGUGGCACCGAGUCGGUGCUUUUUUU.

In some embodiments of the compositions of the disclosure, the gRNA does not bind or does not selectively bind to a second sequence within the RNA molecule.

In some embodiments of the compositions of the disclosure, an RNA genome or an RNA transcriptome comprises the RNA molecule.

In some embodiments of the compositions of the disclosure, the first RNA binding protein comprises a CRISPR-Cas protein. In some embodiments, the CRISPR-Cas protein is a Type II CRISPR-Cas protein. In some embodiments, the first RNA binding protein comprises a Cas9 polypeptide or an RNA-binding portion thereof. In some embodiments, the CRISPR-Cas protein comprises a native RNA nuclease activity. In some embodiments, the native RNA nuclease activity is reduced or inhibited. In some embodiments, the native RNA nuclease activity is increased or induced. In some embodiments, the CRISPR-Cas protein comprises a native DNA nuclease activity and the native DNA nuclease activity is inhibited. In some embodiments, the CRISPR-Cas protein comprises a mutation. In some embodiments, a nuclease domain of the CRISPR-Cas protein comprises the mutation. In some embodiments, the mutation occurs in a nucleic acid encoding the CRISPR-Cas protein. In some embodiments, the mutation occurs in an amino acid encoding the CRISPR-Cas protein. In some embodiments, the mutation comprises a substitution, an insertion, a deletion, a frameshift, an inversion, or a transposition. In some embodiments, the mutation comprises a deletion of a nuclease domain, a binding site within the nuclease domain, an active site within the nuclease domain, or at least one essential amino acid residue within the nuclease domain.

In some embodiments of the compositions of the disclosure, the first RNA binding protein comprises a CRISPR-Cas protein. In some embodiments, the CRISPR-Cas protein is a Type V CRISPR-Cas protein. In some embodiments, the first RNA binding protein comprises a Cpf1 polypeptide or an RNA-binding portion thereof. In some embodiments, the CRISPR-Cas protein comprises a native RNA nuclease activity. In some embodiments, the native RNA nuclease activity is reduced or inhibited. In some embodiments, the native RNA nuclease activity is increased or induced. In some embodiments, the CRISPR-Cas protein comprises a native DNA nuclease activity and the native DNA nuclease activity is inhibited. In some embodiments, the CRISPR-Cas protein comprises a mutation. In some embodiments, a nuclease domain of the CRISPR-Cas protein comprises the mutation. In some embodiments, the mutation occurs in a nucleic acid encoding the CRISPR-Cas protein. In some embodiments, the mutation occurs in an amino acid encoding the CRISPR-Cas protein. In some embodiments, the mutation comprises a substitution, an insertion, a deletion, a frameshift, an inversion, or a transposition. In some embodiments, the mutation comprises a deletion of a nuclease domain, a binding site within the nuclease domain, an active site within the nuclease domain, or at least one essential amino acid residue within the nuclease domain.

In some embodiments of the compositions of the disclosure, the first RNA binding protein comprises a CRISPR-Cas protein. In some embodiments, the CRISPR-Cas protein is a Type VI CRISPR-Cas protein. In some embodiments, the first RNA binding protein comprises a Cas13 polypeptide or an RNA-binding portion thereof. In some embodiments, the first RNA binding protein comprises a CasRx/Cas13d polypeptide or an RNA-binding portion thereof. In some embodiments, the CRISPR-Cas protein comprises a native RNA nuclease activity. In some embodiments, the native RNA nuclease activity is reduced or inhibited. In some embodiments, the native RNA nuclease activity is increased or induced. In some embodiments, the CRISPR-Cas protein comprises a native DNA nuclease activity and the native DNA nuclease activity is inhibited. In some embodiments, the CRISPR-Cas protein comprises a mutation. In some embodiments, a nuclease domain of the CRISPR-Cas protein comprises the mutation. In some embodiments, the mutation occurs in a nucleic acid encoding the CRISPR-Cas protein. In some embodiments, the mutation occurs in an amino acid encoding the CRISPR-Cas protein. In some embodiments, the mutation comprises a substitution, an insertion, a deletion, a frameshift, an inversion, or a transposition. In some embodiments, the mutation comprises a deletion of a nuclease domain, a binding site within the nuclease domain, an active site within the nuclease domain, or at least one essential amino acid residue within the nuclease domain.

In some embodiments of the compositions of the disclosure, the first RNA binding protein comprises a Pumilio and FBF (PUF) protein or an RNA binding portion thereof. In some embodiments, the first RNA binding protein comprises a Pumilio-based assembly (PUMBY) protein or an RNA binding portion thereof.

In some embodiments of the compositions of the disclosure, the first RNA binding protein does not require multimerization for RNA-binding activity. In some embodiments, the first RNA binding protein is not a monomer of a multimer complex. In some embodiments, a multimer protein complex does not comprise the first RNA binding protein.

In some embodiments of the compositions of the disclosure, the first RNA binding protein selectively binds to a target sequence within the RNA molecule. In some embodiments, the first RNA binding protein does not comprise an affinity for a second sequence within the RNA molecule. In some embodiments, the first RNA binding protein does not comprise a high affinity for or selectively bind a second sequence within the RNA molecule.

In some embodiments of the compositions of the disclosure, an RNA genome or an RNA transcriptome comprises the RNA molecule.

In some embodiments of the compositions of the disclosure, the first RNA binding protein comprises between 2 and 1300 amino acids, inclusive of the endpoints.

In some embodiments of the compositions of the disclosure, the sequence encoding the first RNA binding protein further comprises a sequence encoding a nuclear localization signal (NLS), a nuclear export signal (NES) or tag. In some embodiments, the sequence encoding a nuclear localization signal (NLS) is positioned 3' to the sequence encoding the first RNA binding protein. In some embodiments, the first RNA binding protein comprises an NLS at a C-terminus of the protein.

In some embodiments of the compositions of the disclosure, the sequence encoding the first RNA binding protein further comprises a first sequence encoding a first NLS and a second sequence encoding a second NLS. In some embodiments, the sequence encoding the first NLS or the second NLS is positioned 3' to the sequence encoding the first RNA binding protein. In some embodiments, the first RNA binding protein comprises the first NLS or the second NLS at a C-terminus of the protein.

In some embodiments of the compositions of the disclosure, the second RNA binding protein comprises or consists of a nuclease domain. In some embodiments, the second RNA binding protein binds RNA in a manner in which it associates with RNA. In some embodiments, the second RNA binding protein associates with RNA in a manner in which it cleaves RNA.

In some embodiments of the compositions of the disclosure, the sequence encoding the second RNA binding protein comprises or consists of an RNAse. In some embodiments, the second RNA binding protein comprises or consists of an RNAse1. In some embodiments, the RNAse1 comprises or consists of SEQ ID NO: 20. In some embodiments, the second RNA binding protein comprises or consists of an RNAse4. In some embodiments, the RNAse4 comprises or consists of SEQ ID NO: 21. In some embodiments, the second RNA binding protein comprises or consists of an RNAse6. In some embodiments, the RNAse6 comprises or consists of SEQ ID NO: 22. In some embodiments, the second RNA binding protein comprises or consists of an RNAse7. In some embodiments, the RNAse7 comprises or consists of SEQ ID NO: 23. In some embodiments, the second RNA binding protein comprises or consists of an RNAse8. In some embodiments, the RNAse8 protein comprises or consists of SEQ ID NO: 24. In some embodiments, the second RNA binding protein comprises or consists of an RNAse2. In some embodiments, the RNAse2 protein comprises or consists of SEQ ID NO: 25. In some embodiments, the second RNA binding protein comprises or consists of an RNAse6PL. In some embodiments, the RNAse6PL protein comprises or consists of SEQ ID NO: 26. In some embodiments, the second RNA binding protein comprises or consists of an RNAseL. In some embodiments the RNAseL protein comprises or consists of SEQ ID NO: 27. In some embodiments, the second RNA binding protein comprises or consists of an RNAseT2. In some embodiments, the RNAseT2 protein comprises or consists of SEQ ID NO: 28. In some embodiments, the second RNA binding protein comprises or consists of an RNAse11. In some embodiments, the RNAse11 protein comprises or consists of SEQ ID NO: 29. In some embodiments, the second RNA binding protein comprises or consists of an RNAseT2-like.

In some embodiments, the RNAseT2-like protein comprises or consists of SEQ ID NO: 30.

In some embodiments of the compositions of the disclosure, the second RNA binding protein comprises or consists of a mutated RNAse. In some embodiments, the second RNA binding protein comprises or consists of a mutated Rnase1 (Rnase1(K41R)) polypeptide. In some embodiments, the Rnase1 (K41R) polypeptide comprises or consists of SEQ ID NO: 116. In some embodiments, the second RNA binding protein comprises or consists of a mutated Rnase1 (Rnase1(K41R, D121E)) polypeptide. In some embodiments, the Rnase1 (Rnase1(K41R, D121E)) polypeptide comprises or consists of SEQ ID NO: 66. In some embodiments, the second RNA binding protein comprises or consists of a mutated Rnase1 (Rnase1(K41R, D121E, H119N)) polypeptide. In some embodiments, the Rnase1 (Rnase1(K41R, D121E, H119N)) polypeptide comprises or consists of SEQ ID NO: 118. In some embodiments, the second RNA binding protein comprises or consists of a mutated Rnase1. In some embodiments, the second RNA binding protein comprises or consists of a mutated Rnase1 (Rnase1(H119N)) polypeptide. In some embodiments, the Rnase1 (Rnase1(H119N)) polypeptide comprises or consists SEQ ID NO: 119. In some embodiments, the second RNA binding protein comprises or consists of a mutated Rnase1 (Rnase1(R39D, N67D, N88A, G89D, R91D, H119N)) polypeptide. In some embodiments, the Rnase1 (Rnase1(R39D, N67D, N88A, G89D, R91D, H119N)) polypeptide comprises or consists of SEQ ID NO: 120. In some embodiments, the second RNA binding protein comprises or consists of a mutated Rnase1 (Rnase1(R39D, N67D, N88A, G89D, R91D, H119N)) polypeptide. In some embodiments, the Rnase1 (Rnase1(R39D, N67D, N88A, G89D, R91D, H119N, K41R, D121E)) polypeptide comprises or consists of SEQ ID NO: 121. In some embodiments, the second RNA binding protein comprises or consists of a mutated Rnase1 (Rnase1(R39D, N67D, N88A, G89D, R91D, H119N)) polypeptide. In some embodiments, the Rnase1 (Rnase1(R39D, N67D, N88A, G89D, R91D)) polypeptide comprises or consists of SEQ ID NO: 122.

In some embodiments of the compositions of the disclosure, the second RNA binding protein comprises or consists of a NOB1 polypeptide. In some embodiments, the NOB1 polypeptide comprises or consists of SEQ ID NO: 31.

In some embodiments of the compositions of the disclosure, the second RNA binding protein comprises or consists of an endonuclease. In some embodiments, the second RNA binding protein comprises or consists of an endonuclease V (ENDOV). In some embodiments, the ENDOV protein comprises or consists of SEQ ID NO: 32. In some embodiments, the second RNA binding protein comprises or consists of an endonuclease G (ENDOG). In some embodiments, the ENDOG protein comprises or consists of SEQ ID NO: 33. In some embodiments, the second RNA binding protein comprises or consists of an endonuclease D1 (ENDOD1). In some embodiments, the ENDOD1 protein comprises or consists of SEQ ID NO: 34. In some embodiments, the second RNA binding protein comprises or consists of a Human flap endonuclease-1 (hFEN1). In some embodiments, the hFEN1 protein comprises or consists of SEQ ID NO: 35. In some embodiments, the second RNA binding protein comprises or consists of a DNA repair endonuclease XPF (ERCC4) polypeptide. In some embodiments, the ERCC4 protein comprises or consists of SEQ ID NO: 64.

In some embodiments of the compositions of the disclosure, the second RNA binding protein comprises or consists of an Endonuclease III-like protein 1 (NTHL) polypeptide. In some embodiments, the NTHL polypeptide comprises or consists of SEQ ID NO: 123.

In some embodiments of the compositions of the disclosure, the second RNA binding protein comprises or consists of a human Schlafen 14 (hSLFN14) polypeptide. In some embodiments, the hSLFN14 polypeptide comprises or consists of SEQ ID NO: 36.

In some embodiments of the compositions of the disclosure, the second RNA binding protein comprises or consists of a human beta-lactamase-like protein 2 (hLACTB2) polypeptide. In some embodiments, the hLACTB2 polypeptide comprises or consists of SEQ ID NO: 37.

In some embodiments of the compositions of the disclosure, the second RNA binding protein comprises or consists of an apurinic/apyrimidinic (AP) endodeoxyribonuclease (APEX) polypeptide. In some embodiments, the second RNA binding protein comprises or consists of an apurinic/apyrimidinic (AP) endodeoxyribonuclease (APEX2) polypeptide. In some embodiments, the APEX2 polypeptide comprises or consists of SEQ ID NO: 38. In some embodiments, the APEX2 polypeptide comprises or consists of SEQ ID NO: 39. In some embodiments, the second RNA binding protein comprises or consists of an apurinic or apyrimidinic site lyase (APEX1) polypeptide. In some embodiments, the APEX1 polypeptide comprises or consists of SEQ ID NO: 125.

In some embodiments of the compositions of the disclosure, the second RNA binding protein comprises or consists of an angiogenin (ANG) polypeptide. In some embodiments, the ANG polypeptide comprises or consists SEQ ID NO: 40.

In some embodiments of the compositions of the disclosure, the second RNA binding protein comprises or consists of a heat responsive protein 12 (HRSP12) polypeptide. In some embodiments, the HRSP12 polypeptide comprises or consists of SEQ ID NO: 41.

In some embodiments of the compositions of the disclosure, the second RNA binding protein comprises or consists of a Zinc Finger CCCH-Type Containing 12A (ZC3H12A) polypeptide. In some embodiments, the ZC3H12A polypeptide comprises or consists of SEQ ID NO: 42. In some embodiments, the ZC3H12A polypeptide comprises or consists of SEQ ID NO: 43.

In some embodiments of the compositions of the disclosure, the second RNA binding protein comprises or consists of a Reactive Intermediate Imine Deaminase A (RIDA) polypeptide. In some embodiments, the RIDA polypeptide comprises or consists of SEQ ID NO: 44.

In some embodiments of the compositions of the disclosure, the second RNA binding protein comprises or consists of a Phospholipase D Family Member 6 (PDL6) polypeptide. In some embodiments, the PDL6 polypeptide comprises or consists of SEQ ID NO: 126.

In some embodiments of the compositions of the disclosure, the second RNA binding protein comprises or consists of a mitochondrial ribonuclease P catalytic subunit (KIAA0391) polypeptide. In some embodiments, the KIAA0391 polypeptide comprises or consists of SEQ ID NO: 127.

In some embodiments of the compositions of the disclosure, the second RNA binding protein comprises or consists of an argonaute 2 (AGO2) polypeptide.

In some embodiments of the compositions of the disclosure, the AGO2 polypeptide comprises or consists of SEQ ID NO: 128.

In some embodiments of the compositions of the disclosure, the second RNA binding protein comprises or consists of a mitochondrial nuclease EXOG (EXOG) polypeptide. In some embodiments, the EXOG polypeptide comprises or consists of SEQ ID NO: 129.

In some embodiments of the compositions of the disclosure, the second RNA binding protein comprises or consists of a Zinc Finger CCCH-Type Containing 12D (ZC3H12D) polypeptide. In some embodiments, the ZC3H12D polypeptide comprises or consists of SEQ ID NO: 130.

In some embodiments of the compositions of the disclosure, the second RNA binding protein comprises or consists of an endoplasmic reticulum to nucleus signaling 2 (ERN2) polypeptide. In some embodiments, the ERN2 polypeptide comprises or consists of SEQ ID NO: 131.

In some embodiments of the compositions of the disclosure, the second RNA binding protein comprises or consists of a pelota mRNA surveillance and ribosome rescue factor (PELO) polypeptide. In some embodiments, the PELO polypeptide comprises or consists of SEQ ID NO: 132.

In some embodiments of the compositions of the disclosure, the second RNA binding protein comprises or consists of a YBEY metallopeptidase (YBEY) polypeptide. In some embodiments, the YBEY polypeptide comprises or consists of SEQ ID NO: 133.

In some embodiments of the compositions of the disclosure, the second RNA binding protein comprises or consists of a cleavage and polyadenylation specific factor 4 like (CPSF4L) polypeptide. In some embodiments, the CPSF4L polypeptide comprises or consists of SEQ ID NO: 134.

In some embodiments of the compositions of the disclosure, the second RNA binding protein comprises or consists of an hCG_2002731 polypeptide. In some embodiments, the hCG_2002731 comprises or consists of SEQ ID NO: 135. In some embodiments, the hCG_2002731 polypeptide comprises or consists of SEQ ID NO: 136.

In some embodiments of the compositions of the disclosure, the second RNA binding protein comprises or consists of an Excision Repair Cross-Complementation Group 1 (ERCC1) polypeptide. In some embodiments, the ERCC1 polypeptide comprises or consists of SEQ ID NO: 137.

In some embodiments of the compositions of the disclosure, the second RNA binding protein comprises or consists of a ras-related C3 botulinum toxin substrate 1 isoform (RAC1) polypeptide. In some embodiments, the RAC1 polypeptide comprises or consists of SEQ ID NO: 138.

In some embodiments of the compositions of the disclosure, the second RNA binding protein comprises or consists of a Ribonuclease A A1 (RAA1) polypeptide. In some embodiments, the RAA1 polypeptide comprises or consists of SEQ ID NO: 139.

In some embodiments of the compositions of the disclosure, the second RNA binding protein comprises or consists of a Ras Related Protein (RAB1) polypeptide. In some embodiments, the RAB1 polypeptide comprises or consists of SEQ ID NO: 140.

In some embodiments of the compositions of the disclosure, the second RNA binding protein comprises or consists of a DNA Replication Helicase/Nuclease 2 (DNA2) polypeptide. In some embodiments, the DNA2 polypeptide comprises or consists of SEQ ID NO: 141.

In some embodiments of the compositions of the disclosure, the second RNA binding protein comprises or consists of a FLJ35220 polypeptide. In some embodiments, the FLJ35220 polypeptide comprises or consists of SEQ ID NO: 142.

In some embodiments of the compositions of the disclosure, the second RNA binding protein comprises or consists of a FLJ13173 polypeptide. In some embodiments, the FLJ13173 polypeptide comprises or consists of SEQ ID NO: 143.

In some embodiments of the compositions of the disclosure, the second RNA binding protein comprises or consists of Teneurin Transmembrane Protein (TENM) polypeptide. In some embodiments, the second RNA binding protein comprises or consists of Teneurin Transmembrane Protein 1 (TENM1) polypeptide. In some embodiments, the TENM1 polypeptide comprises or consists of SEQ ID NO: 144. In some embodiments, the second RNA binding protein comprises or consists of Teneurin Transmembrane Protein 2 (TENM2) polypeptide. In some embodiments, the TENM2 polypeptide comprises or consists of SEQ ID NO: 145.

In some embodiments of the compositions of the disclosure, the second RNA binding protein comprises or consists of a Ribonuclease Kappa (RNAseK) polypeptide. In some embodiments, the RNAseK polypeptide comprises or consists of SEQ ID NO: 204.

In some embodiments, the fusion proteins of the disclosure are used in methods for treating a subject in need thereof, the methods comprising contacting a target RNA with a fusion protein or the sequence encoding the fusion protein.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

(FIG. 1A) An RNA-targeting Cas9 system fused to an endonuclease targets and cleaves a disease-causing RNA. (FIG. 1B) Depicts an application of (A) in the context of myotonic dystrophy type 1, wherein an RNA-targeting Cas9 system fused to an endonuclease targets and cleaves a repetitive RNA composed of repeating CUG units. In the absence of the RNA-targeting Cas9 system, the repetitive RNA composed of repeating CUG units binds to a splicing factor MBNL and causes pathology via dysfunctional RNA splicing. Cleavage of this repetitive RNA ameliorates disease.

FIG. 6 is a table providing a key to the endonucleases shown in FIGS. 4B, 5B, and 9.

FIG. 7B is a graph depicting changes in expression levels of Zika NS5 in the presence of both E43 and E67 CjeCas9-endonuclease fusions with sgRNAs containing the various NS5-targeting spacer sequences as indicated in Table 2. Zika NS5 expression is displayed as fold change relative to the endonuclease loaded with an sgRNA containing a control (Lambda) spacer sequence.

DETAILED DESCRIPTION

Figure 1A:
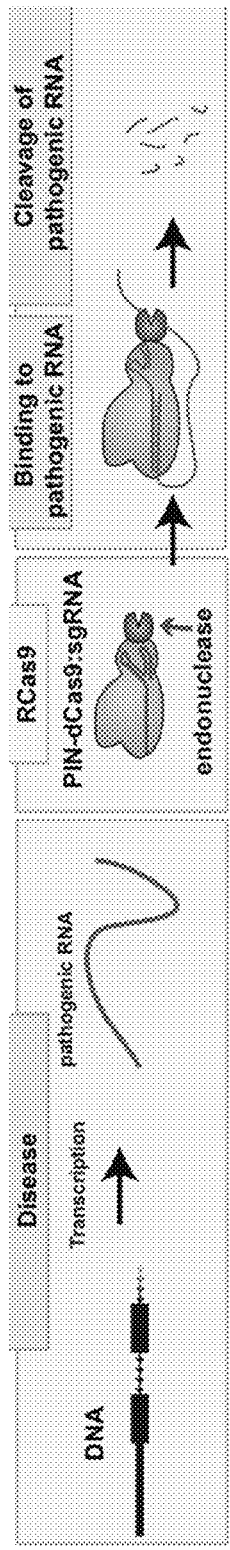
FIGS. 1A-B is a schematic diagram of an exemplary embodiment of a composition of the disclosure.
Figure 1B:
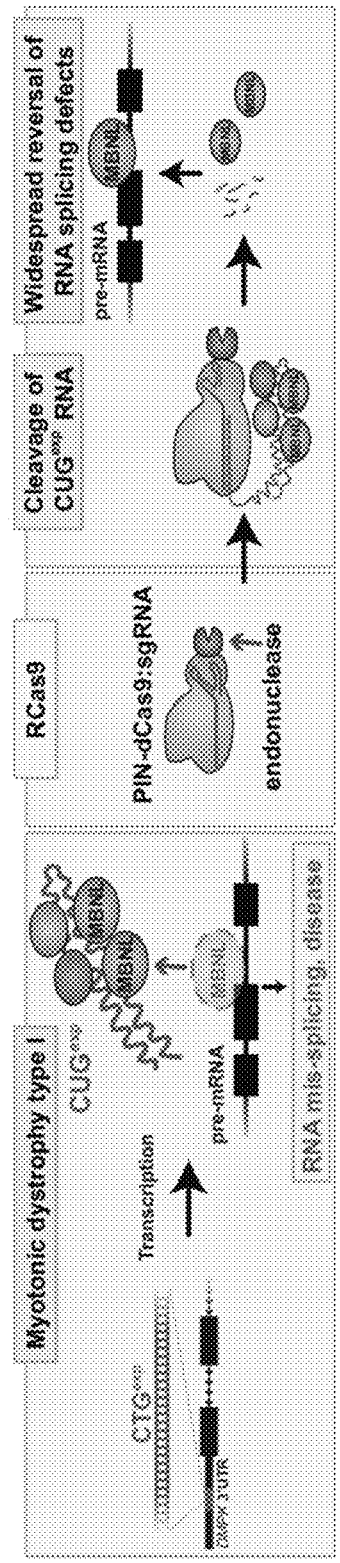
Figure 2:
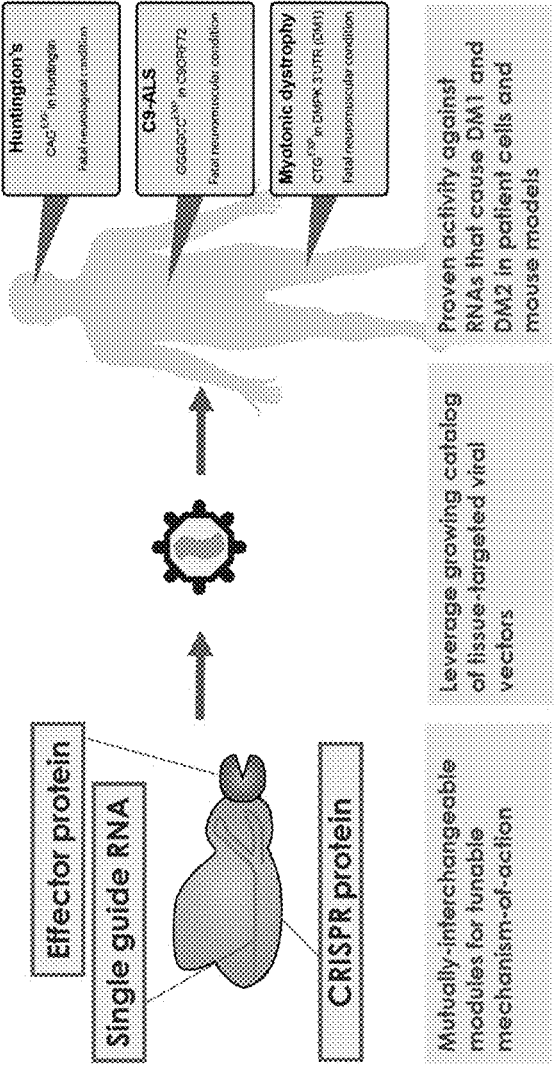
FIG. 2 is a schematic diagram depicting an exemplary modular therapeutic platform for treating genetic disease by targeting RNA molecules.
Figure 3A:
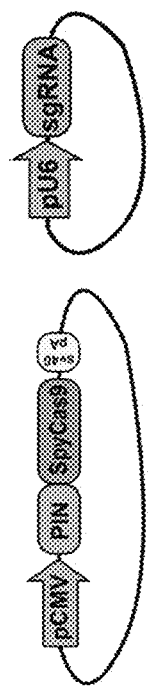
FIGS. 3A-B is a pair of schematic diagrams depicting (FIG. 3A) a "high expression" control system (also referred to as "pos control") comprising a two plasmid system comprising a cytomegalovirus promoter driving expression of the RNA endonuclease/Cas9 fusion and (FIG. 3B) a "low expression" control system (also referred to as "P13") comprising a single plasmid system comprising a lower-expression promoter (pEFS) driving expression of the RNA endonuclease/Cas9 fusion.
Figure 3B:
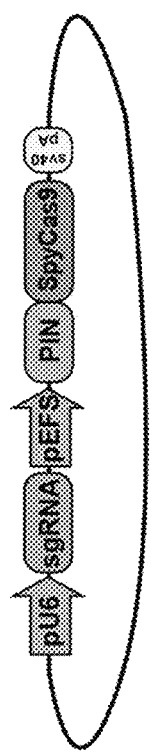
Figure 4A:
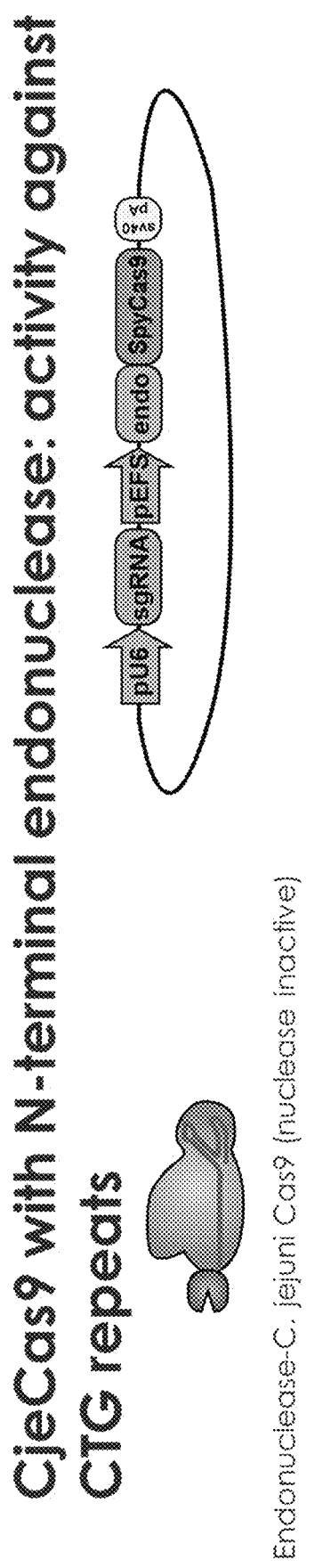
FIG. 4A is a pair of schematic diagrams depicting an exemplary RNA Endonuclease-*C. jejuni* Cas9 fusion protein (left) and a vector comprising an exemplary RNA Endonuclease-*S. pyogenes* Cas9 fusion protein (right)
Figure 4B:
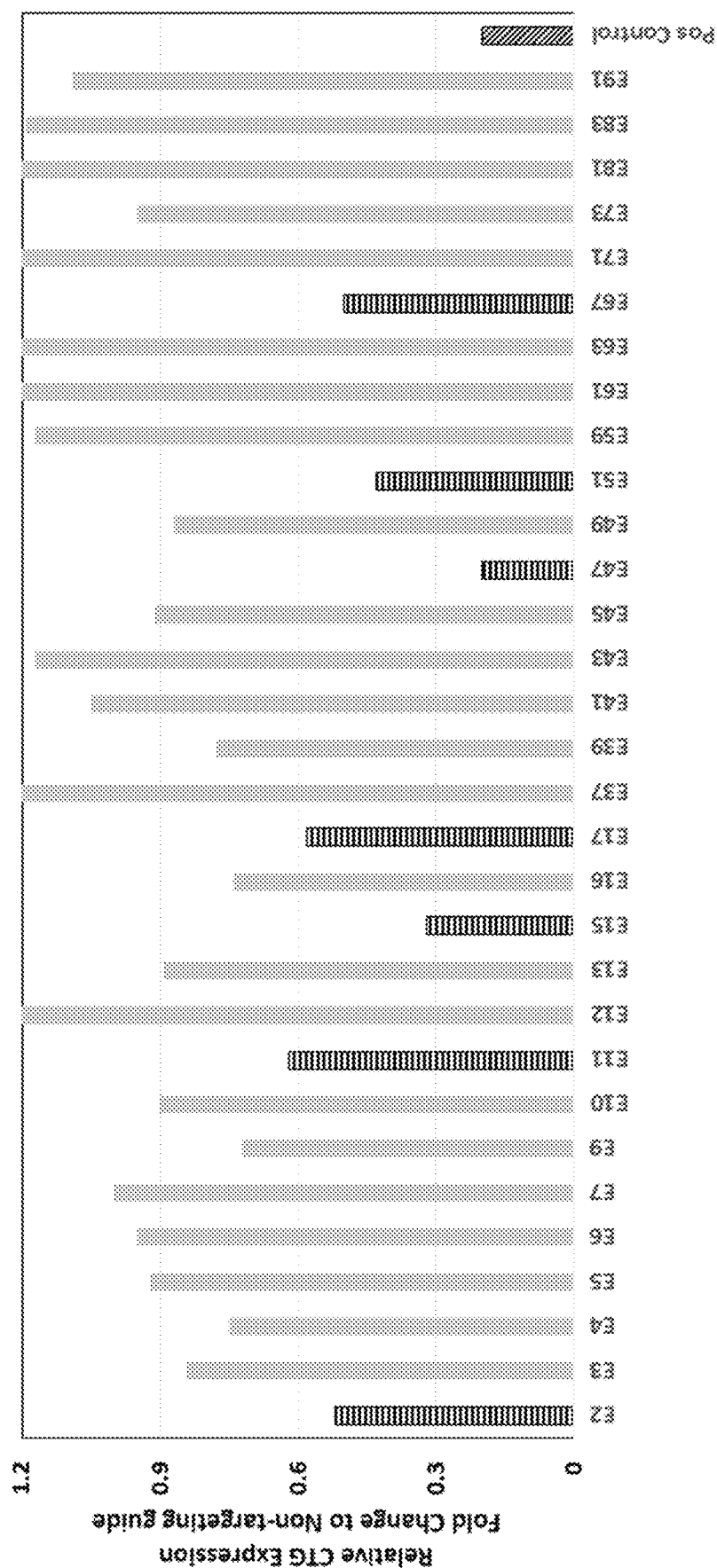
FIG. 4B is a graph depicting the ability of a variety of fusion proteins comprising either *C. jejuni* Cas9 or *S. pyogenes* Cas9, as shown in FIG. 4A, to cleave repetitive RNA molecules.
Figure 5A:
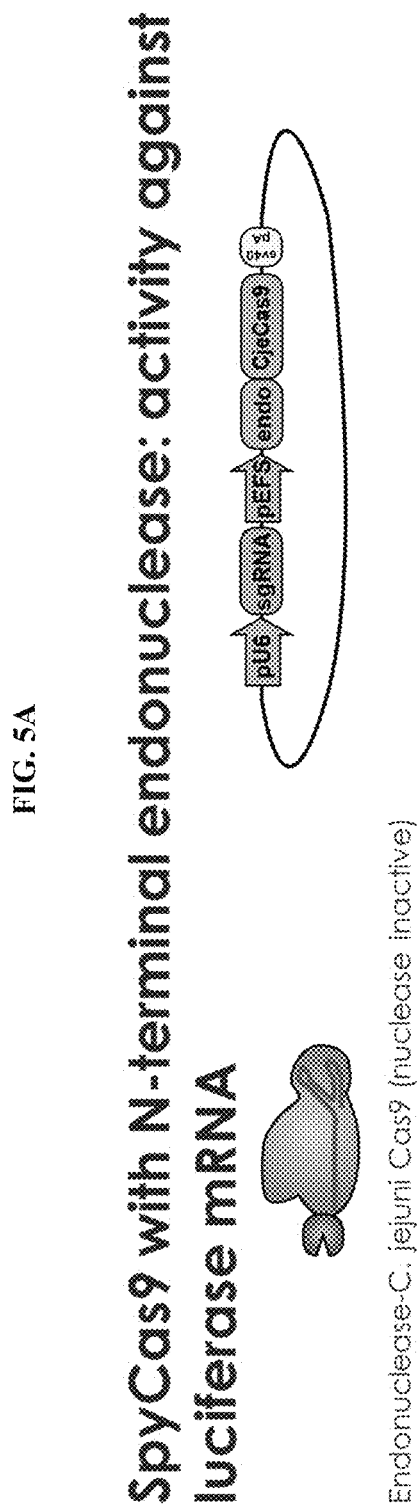
FIG. 5A is a pair of schematic diagrams depicting an exemplary RNA Endonuclease-*C. jejuni* Cas9 fusion protein (left) and a vector comprising an exemplary RNA Endonuclease-*S. pyogenes* Cas9 fusion protein (right)
Figure 5B:
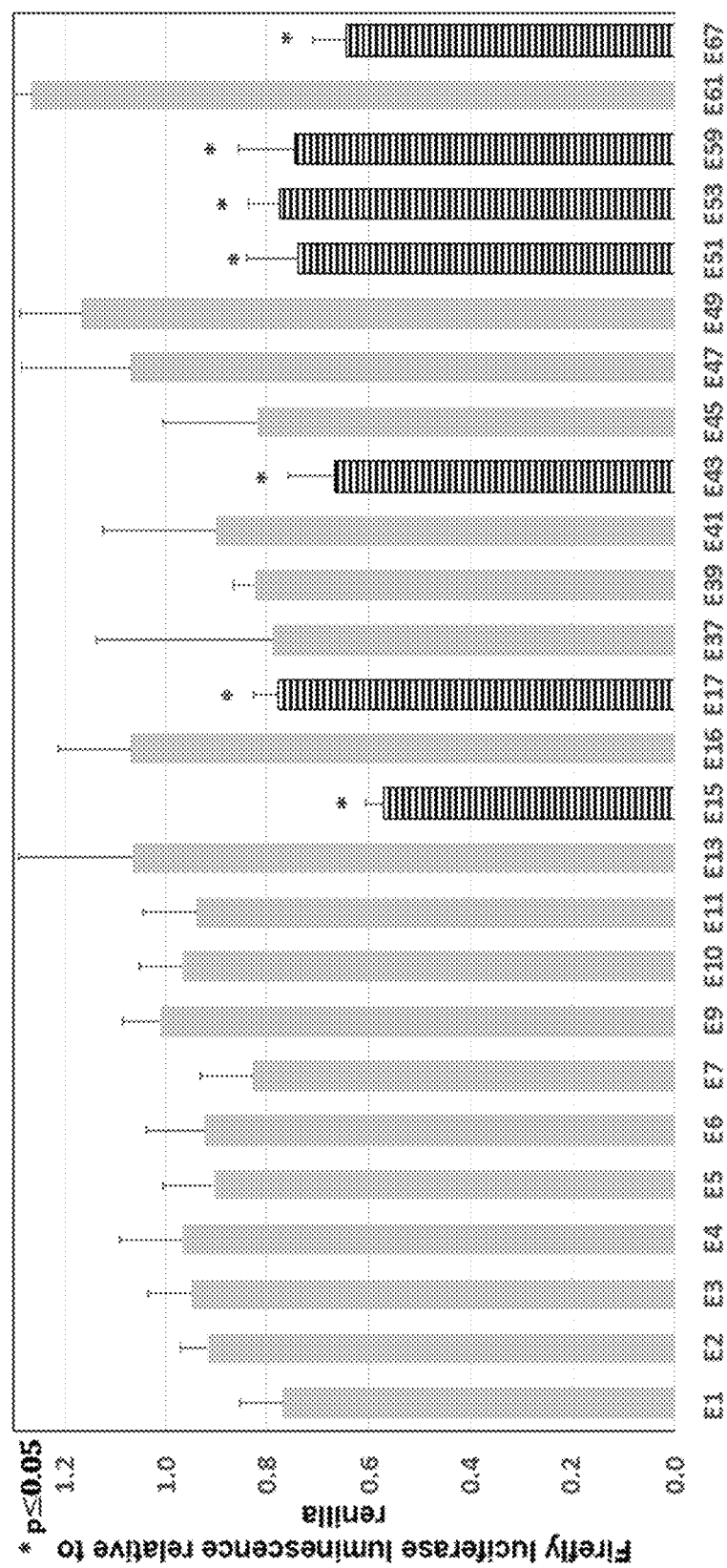
FIG. 5B is a graph depicting the ability of a variety of fusion proteins comprising either *C. jejuni* Cas9 or *S. pyogenes* Cas9, as shown in FIG. 5A, to cleave mRNA molecules encoding a luciferase protein.

The disclosure provides an RNA-guided fusion protein that selectively binds and, optionally, cleaves RNA molecules. The disclosure provides vectors, compositions and cells comprising the RNA-guided fusion protein. The disclosure provides methods of using the RNA-guided fusion protein, vectors, compositions and cells of the disclosure to treat a disease or disorder.

Guide RNA

The terms guide RNA (gRNA) and single guide RNA (sgRNA) are used interchangeably throughout the disclosure.

Guide RNAs (gRNAs) of the disclosure may comprise of a spacer sequence and a scaffolding sequence. In some embodiments, a guide RNA is a single guide RNA (sgRNA) comprising a contiguous spacer sequence and scaffolding sequence. In some embodiments, the spacer sequence and the scaffolding sequence are not contiguous. In some embodiments, a scaffold sequence comprises a "direct repeat" (DR) sequence. DR sequences refer to the repetitive sequences in the CRISPR locus (naturally-occurring in a bacterial genome or plasmid) that are interspersed with the spacer sequences. It is well known that one would be able to infer the DR sequence of a corresponding Cas protein if the sequence of the associated CRISPR locus is known. In some embodiments, a sequence encoding a guide RNA or single guide RNA of the disclosure comprises or consists of a spacer sequence and a scaffolding sequence, that are separated by a linker sequence. In some embodiments, the linker sequence may comprise or consist of 1, 2, 3, 4, 5, 6, 7, 8, 9, 10, 15, 20, 25, 30, 35, 40, 45, 50 or any number of nucleotides in between. In some embodiments, the linker sequence may comprise at least 1, 2, 3, 4, 5, 6, 7, 8, 9, 10, 15, 20, 25, 30, 35, 40, 45, 50 or any number of nucleotides in between.

Guide RNAs (gRNAs) of the disclosure may comprise non-naturally occurring nucleotides. In some embodiments, a guide RNA of the disclosure or a sequence encoding the guide RNA comprises or consists of modified or synthetic RNA nucleotides. Exemplary modified RNA nucleotides include, but are not limited to, pseudouridine (T), dihydrouridine (D), inosine (I), and 7-methylguanosine (m7G), hypoxanthine, xanthine, xanthosine, 7-methylguanine, 5,6-Dihydrouracil, 5-methylcytosine, 5-methylcytidine, 5-hydropxymethylcytosine, isoguanine, and isocytosine.

Guide RNAs (gRNAs) of the disclosure may bind modified RNA within a target sequence. Within a target sequence, guide RNAs (gRNAs) of the disclosure may bind modified RNA. Exemplary epigenetically or post-transcriptionally modified RNA include, but are not limited to, 2'-O-Methylation (2'-OMe) (2'-O-methylation occurs on the oxygen of the free 2'-OH of the ribose moiety), N6-methyladenosine (m6A), and 5-methylcytosine (m5C).

In some embodiments of the compositions of the disclosure, a guide RNA of the disclosure comprises at least one sequence encoding a non-coding C/D box small nucleolar RNA (snoRNA) sequence. In some embodiments, the snoRNA sequence comprises at least one sequence that is complementary to the target RNA, wherein the target sequence of the RNA molecule comprises at least one 2'-OMe. In some embodiments, the snoRNA sequence comprises at least one sequence that is complementary to the target RNA, wherein the at least one sequence that is complementary to the target RNA comprises a box C motif (RUGAUGA) and a box D motif (CUGA).

Spacer sequences of the disclosure bind to the target sequence of an RNA molecule. Spacer sequences of the disclosure may comprise a CRISPR RNA (crRNA). Spacer sequences of the disclosure comprise or consist of a sequence having sufficient complementarity to a target sequence of an RNA molecule to bind selectively to the target sequence. Upon binding to a target sequence of an RNA molecule, the spacer sequence may guide one or more of a scaffolding sequence and a fusion protein to the RNA molecule. In some embodiments, a sequence having sufficient complementarity to a target sequence of an RNA molecule to bind selectively to the target sequence has at least 50%, 55%, 60%, 65%, 70%, 75%, 80%, 85%, 90%, 95%, 96, 97%, 98%, 99%, or any percentage identity in between to the target sequence. In some embodiments, a sequence having sufficient complementarity to a target sequence of an RNA molecule to bind selectively to the target sequence has 100% identity the target sequence.

Scaffolding sequences of the disclosure bind the first RNA-binding polypeptide of the disclosure. Scaffolding sequences of the disclosure may comprise a trans acting RNA (tracrRNA). Scaffolding sequences of the disclosure comprise or consist of a sequence having sufficient complementarity to a target sequence of an RNA molecule to bind selectively to the target sequence. Upon binding to a target sequence of an RNA molecule, the scaffolding sequence may guide a fusion protein to the RNA molecule. In some embodiments, a sequence having sufficient complementarity to a target sequence of an RNA molecule to bind selectively to the target sequence has at least 50%, 55%, 60%, 65%, 70%, 75%, 80%, 85%, 90%, 95%, 96, 97%, 98%, 99%, or any percentage identity in between to the target sequence. In some embodiments, a sequence having sufficient complementarity to a target sequence of an RNA molecule to bind selectively to the target sequence has 100% identity the target sequence. Alternatively, or in addition, in some embodiments, scaffolding sequences of the disclosure comprise or consist of a sequence that binds to a first RNA binding protein or a second RNA binding protein of a fusion protein of the disclosure. In some embodiments, scaffolding sequences of the disclosure comprise a secondary structure or a tertiary structure. Exemplary secondary structures include, but are not limited to, a helix, a stem loop, a bulge, a tetraloop and a pseudoknot. Exemplary tertiary structures include, but are not limited to, an A-form of a helix, a B-form of a helix, and a Z-form of a helix. Exemplary tertiary structures include, but are not limited to, a twisted or helicized stem loop. Exemplary tertiary structures include, but are not limited to, a twisted or helicized pseudoknot. In some embodiments, scaffolding sequences of the disclosure comprise at least one secondary structure or at least one tertiary structure. In some embodiments, scaffolding sequences of the disclosure comprise one or more secondary structure(s) or one or more tertiary structure(s).

In some embodiments of the compositions of the disclosure, a guide RNA or a portion thereof selectively binds to a tetraloop motif in an RNA molecule of the disclosure. In some embodiments, a target sequence of an RNA molecule comprises a tetraloop motif. In some embodiments, the tetraloop motif is a "GRNA" motif comprising or consisting of one or more of the sequences of GAAA, GUGA, GCAA or GAGA.

In some embodiments of the compositions of the disclosure, a guide RNA or a portion thereof that binds to a target sequence of an RNA molecule hybridizes to the target sequence of the RNA molecule. In some embodiments, a guide RNA or a portion thereof that binds to a first RNA binding protein or to a second RNA binding protein covalently binds to the first RNA binding protein or to the second RNA binding protein. In some embodiments, a guide RNA or a portion thereof that binds to a first RNA binding protein or to a second RNA binding protein non-covalently binds to the first RNA binding protein or to the second RNA binding protein.

In some embodiments of the compositions of the disclosure, a guide RNA or a portion thereof comprises or consists of between 10 and 100 nucleotides, inclusive of the endpoints. In some embodiments, a spacer sequence of the disclosure comprises or consists of between 10 and 30 nucleotides, inclusive of the endpoints. In some embodiments, a spacer sequence of the disclosure comprises or consists of 15, 16, 17, 18, 19, 20, 21, 22, 23, 24, 25, 26, 27, 28, 29 or 30 nucleotides. In some embodiments, the spacer sequence of the disclosure comprises or consists of 20 nucleotides. In some embodiments, the spacer sequence of the disclosure comprises or consists of 21 nucleotides. In some embodiments, a scaffold sequence of the disclosure comprises or consists of between 10 and 100 nucleotides, inclusive of the endpoints. In some embodiments, a scaffold sequence of the disclosure comprises or consists of 30, 35, 40, 45, 50, 55, 60, 65, 70, 76, 80, 87, 90, 95, 100 or any number of nucleotides in between. In some embodiments, the scaffold sequence of the disclosure comprises or consists of between 85 and 95 nucleotides, inclusive of the endpoints. In some embodiments, the scaffold sequence of the disclosure comprises or consists of 85 nucleotides. In some embodiments, the scaffold sequence of the disclosure comprises or consists of 90 nucleotides. In some embodiments, the scaffold sequence of the disclosure comprises or consists of 93 nucleotides.

In some embodiments of the compositions of the disclosure, a guide RNA or a portion thereof does not comprise a nuclear localization sequence (NLS).

In some embodiments of the compositions of the disclosure, a guide RNA or a portion thereof does not comprise a sequence complementary to a protospacer adjacent motif (PAM).

Therapeutic or pharmaceutical compositions of the disclosure do not comprise a PAMmer oligonucleotide. In other embodiments, optionally, non-therapeutic or non-pharmaceutical compositions may comprise a PAMmer oligonucleotide. The term "PAMmer" refers to an oligonucleotide comprising a PAM sequence that is capable of interacting with a guide nucleotide sequence-programmable RNA binding protein. Non-limiting examples of PAMmers are described in O'Connell et al. Nature 516, pages 263-266 (2014), incorporated herein by reference. A PAM sequence refers to a protospacer adjacent motif comprising about 2 to about 10 nucleotides. PAM sequences are specific to the guide nucleotide sequence-programmable RNA binding protein with which they interact and are known in the art. For example, *Streptococcus pyogenes* PAM has the sequence 5'-NGG-3', where "N" is any nucleobase followed by two guanine ("G") nucleobases. Cas9 of *Francisella novicida* recognizes the canonical PAM sequence 5'-NGG-3', but has been engineered to recognize the PAM 5'-YG-3' (where "Y" is a pyrimidine), thus adding to the range of possible Cas9 targets. The Cpf1 nuclease of *Francisella novicida* recognizes the PAM 5'-TTTN-3' or 5'-YTN-3'.

In some embodiments of the compositions of the disclosure, a guide RNA or a portion thereof comprises a sequence complementary to a protospacer flanking sequence (PFS). In some embodiments, including those wherein a guide RNA or a portion thereof comprises a sequence complementary to a PFS, the first RNA binding protein may comprise a sequence isolated or derived from a Cas13 protein. In some embodiments, including those wherein a guide RNA or a portion thereof comprises a sequence complementary to a PFS, the first RNA binding protein may comprise a sequence encoding a Cas13 protein or an RNA-binding portion thereof. In some embodiments, the guide RNA or a portion thereof does not comprise a sequence complementary to a PFS.

In some embodiments of the compositions of the disclosure, guide RNA sequence of the disclosure comprises a promoter sequence to drive expression of the guide RNA. In some embodiments, a vector comprising a guide RNA sequence of the disclosure comprises a promoter sequence to drive expression of the guide RNA. In some embodiments, the promoter to drive expression of the guide RNA is a constitutive promoter. In some embodiments, the promoter sequence is an inducible promoter. In some embodiments, the promoter is a sequence is a tissue-specific and/or cell-type specific promoter. In some embodiments, the promoter is a hybrid or a recombinant promoter. In some embodiments, the promoter is a promoter capable of expressing the guide RNA in a mammalian cell. In some embodiments, the promoter is a promoter capable of expressing the guide RNA in a human cell. In some embodiments, the promoter is a promoter capable of expressing the guide RNA and restricting the guide RNA to the nucleus of the cell. In some embodiments, the promoter is a human RNA polymerase promoter or a sequence isolated or derived from a sequence encoding a human RNA polymerase promoter. In some embodiments, the promoter is a U6 promoter or a sequence isolated or derived from a sequence encoding a U6 promoter. In some embodiments, the promoter is a human tRNA promoter or a sequence isolated or derived from a sequence encoding a human tRNA promoter. In some embodiments, the promoter is a human valine tRNA promoter or a sequence isolated or derived from a sequence encoding a human valine tRNA promoter.

In some embodiments of the compositions of the disclosure, a promoter to drive expression of the guide RNA further comprises a regulatory element. In some embodiments, a vector comprising a promoter sequence to drive expression of the guide RNA further comprises a regulatory element. In some embodiments, a regulatory element enhances expression of the guide RNA. Exemplary regulatory elements include, but are not limited to, an enhancer element, an intron, an exon, or a combination thereof.

In some embodiments of the compositions of the disclosure, a vector of the disclosure comprises one or more of a sequence encoding a guide RNA, a promoter sequence to drive expression of the guide RNA and a sequence encoding a regulatory element. In some embodiments of the compositions of the disclosure, the vector further comprises a sequence encoding a fusion protein of the disclosure.

Fusion Proteins

Fusion proteins of the disclosure comprise a first RNA binding protein and a second RNA binding protein. In some embodiments, along a sequence encoding the fusion protein, the sequence encoding the first RNA binding protein is positioned 5' of the sequence encoding the second RNA binding protein. In some embodiments, along a sequence encoding the fusion protein, the sequence encoding the first RNA binding protein is positioned 3' of the sequence encoding the second RNA binding protein.

In some embodiments of the compositions of the disclosure, the sequence encoding the first RNA binding protein comprises a sequence isolated or derived from a protein capable of binding an RNA molecule. In some embodiments, the sequence encoding the first RNA binding protein comprises a sequence isolated or derived from a protein capable of selectively binding an RNA molecule and not binding a DNA molecule, a mammalian DNA molecule or any DNA molecule. In some embodiments, the sequence encoding the first RNA binding protein comprises a sequence isolated or derived from a protein capable of binding an RNA molecule and inducing a break in the RNA molecule. In some embodiments, the sequence encoding the first RNA binding protein comprises a sequence isolated or derived from a protein capable of binding an RNA molecule, inducing a break in the RNA molecule, and not binding a DNA molecule, a mammalian DNA molecule or any DNA molecule. In some embodiments, the sequence encoding the first RNA binding protein comprises a sequence isolated or derived from a protein capable of binding an RNA molecule, inducing a break in the RNA molecule, and neither binding nor inducing a break in a DNA molecule, a mammalian DNA molecule or any DNA molecule.

In some embodiments of the compositions of the disclosure, the sequence encoding the first RNA binding protein comprises a sequence isolated or derived from a protein with no DNA nuclease activity.

In some embodiments of the compositions of the disclosure, the sequence encoding the first RNA binding protein comprises a sequence isolated or derived from a protein having DNA nuclease activity, wherein the DNA nuclease activity does not induce a break in a DNA molecule, a mammalian DNA molecule or any DNA molecule when a composition of the disclosure is contacted to an RNA molecule or introduced into a cell or into a subject of the disclosure.

In some embodiments of the compositions of the disclosure, the sequence encoding the first RNA binding protein comprises a sequence isolated or derived from a protein having DNA nuclease activity, wherein the DNA nuclease activity is inactivated and wherein the DNA nuclease activity does not induce a break in a DNA molecule, a mammalian DNA molecule or any DNA molecule when a composition of the disclosure is contacted to an RNA molecule or introduced into a cell or into a subject of the disclosure. In some embodiments, the sequence encoding the first RNA binding protein comprises a mutation that inactivates or decreases the DNA nuclease activity to a level at which the DNA nuclease activity does not induce a break in a DNA molecule, a mammalian DNA molecule or any DNA molecule when a composition of the disclosure is contacted to an RNA molecule or introduced into a cell or into a subject of the disclosure. In some embodiments, the sequence encoding the first RNA binding protein comprises a mutation that inactivates or decreases the DNA nuclease activity and the mutation comprises one or more of a substitution, inversion, transposition, insertion, deletion, or any combination thereof to a nucleic acid sequence or amino acid sequence encoding the first RNA binding protein or a nuclease domain thereof.

In some embodiments of the compositions of the disclosure, the sequence encoding the first RNA binding protein of an RNA-guided fusion protein disclosed herein comprises a sequence isolated or derived from a CRISPR Cas protein. In some embodiments, the CRISPR Cas protein comprises a Type II CRISPR Cas protein. In some embodiments, the Type II CRISPR Cas protein comprises a Cas9 protein. Exemplary Cas9 proteins of the disclosure may be isolated or derived from any species, including, but not limited to, a bacteria or an archaea. Exemplary Cas9 proteins of the disclosure may be isolated or derived from any species, including, but not limited to, *Streptococcus pyogenes, Haloferax mediteranii, Mycobacterium tuberculosis, Francisella tularensis* subsp. *novicida, Pasteurella multocida, Neisseria meningitidis, Campylobacter jejune, Streptococcus thermophilus, Campylobacter lari* CF89-12, *Mycoplasma gallisepticum* str. F, *Nitratifractor salsuginis* str. DSM 16511, *Parvibaculum lavamentivorans, Roseburia intestinalis, Neisseria cinerea,* a *Gluconacetobacter diazotrophicus,* an *Azospirillum* B510, a *Sphaerochaeta globus* str. Buddy, *Flavobacterium columnare, Fluviicola taffensis, Bacteroides coprophilus, Mycoplasma mobile, Lactobacillus farciminis, Streptococcus pasteurianus, Lactobacillus johnsonii, Staphylococcus pseudintermedius, Filifactor alocis, Treponema denticola, Legionella pneumophila* str. Paris, *Sutterella wadsworthensis, Corynebacter diphtherias, Streptococcus aureus,* and *Francisella novicida.*

Exemplary wild type *S. pyogenes* Cas9 proteins of the disclosure may comprise or consist of the amino acid sequence:

(SEQ ID NO: 147)
```
  1 MDKKYSIGLD IGTNSVGWAV ITDEYKVPSK KFKVLGNTDR HSIKKNLIGA LLFDSGETAE

61 ATRLKRTARR RYTRRKNRIC YLQEIFSNEM AKVDDSFFHR LEESFLVEED KKHERHPIFG

121 NIVDEVAYHE KYPTIYHLRK KLVDSTDKAD LRLIYLALAH MIKFRGHFLI EGDLNPDNSD

181 VDKLFIQLVQ TYNQLFEENP INASGVDAKA ILSARLSKSR RLENLIAQLP GEKKNGLFGN
```

```
241 LIALSLGLTP NFKSNFDLAE DAKLQLSKDT YDDDLDNLLA QIGDQYADLF LAAKNLSDAI

301 LLSDILRVNT EITKAPLSAS MIKRYDEHHQ DLTLLKALVR QQLPEKYKEI FFDQSKNGYA

361 GYIDGGASQE EFYKFIKPIL EKMDGTEELL VKLNREDLLR KQRTFDNGSI PHQIHLGELH

421 AILRRQEDFY PFLKDNREKI EKILTFRIPY YVGPLARGNS RFAWMTRKSE ETITPWNFEE

481 VVDKGASAQS FIERMTNFDK NLPNEKVLPK HSLLYEYFTV YNELTKVKYV TEGMRKPAFL

541 SGEQKKAIVD LLFKTNRKVT VKQLKEDYFK KIECFDSVEI SGVEDRFNAS LGTYHDLLKI

601 IKDKDFLDNE ENEDILEDIV LTLTLFEDRE MIEERLKTYA HLFDDKVMKQ LKRRRYTGWG

661 RLSRKLINGI RDKQSGKTIL DFLKSDGFAN RNFMQLIHDD SLTFKEDIQK AQVSGQGDSL

721 HEHIANLAGS PAIKKGILQT VKVVDELVKV MGRHKPENIV IEMARENQTT QKGQKNSRER

781 MKRIEEGIKE LGSQILKEHP VENTQLQNEK LYLYYLQNGR DMYVDQELDI NRLSDYDVDH

841 IVPQSFLKDD SIDNKVLTRS DKNRGKSDNV PSEEVVKKMK NYWRQLLNAK LITQRKFDNL

901 TKAERGGLSE LDKAGFIKRQ LVETRQITKH VAQILDSRMN TKYDENDKLI REVKVITLKS

961 KLVSDFRKDF QFYKVREINN YHHAHDAYLN AVVGTALIKK YPKLESEFVY GDYKVYDVRK

1021 MIAKSEQEIG KATAKYFFYS NIMNFFKTEI TLANGEIRKR PLIETNGETG EIVWDKGRDF

1081 ATVRKVLSMP QVNIVKKTEV QTGGFSKESI LPKRNSDKLI ARKKDWDPKK YGGFDSPTVA

1141 YSVLVVAKVE KGKSKKLKSV KELLGITIME RSSFEKNPID FLEAKGYKEV KKDLIIKLPK

1201 YSLFELENGR KRMLASAGEL QKGNELALPS KYVNFLYLAS HYEKLKGSPE DNEQKQLFVE

1261 QHKHYLDEII EQISEFSKRV ILADANLDKV LSAYNKHRDK PIREQAENII HLFTLTNLGA

1321 PAAFKYFDTT IDRKRYTSTK EVLDATLIHQ SITGLYETRI DLSQLGGD.
```

Nuclease inactivated *S. pyogenes* Cas9 proteins may comprise a substitution of an Alanine (A) for an Aspartic Acid (D) at position 10 and an alanine (A) for a Histidine (H) at position 840. Exemplary nuclease inactivated *S. pyogenes* Cas9 proteins of the disclosure may comprise or consist of the amino acid sequence (D10A and H840A bolded and underlined):

```
                                                    (SEQ ID NO: 148)
   1 MDKKYSIGLA IGTNSVGWAV ITDEYKVPSK KFKVLGNTDR HSIKKNLIGA LLFDSGETAE

61 ATRLKRTARR RYTRRKNRIC YLQEIFSNEM AKVDDSFFHR LEESFLVEED KKHERHPIFG

121 NIVDEVAYHE KYPTIYHLRK KLVDSTDKAD LRLIYLALAH MIKFRGHFLI EGDLNPDNSD

181 VDKLFIQLVQ TYNQLFEENP INASGVDAKA ILSARLSKSR RLENLIAQLP GEKKNGLFGN

241 LIALSLGLTP NFKSNFDLAE DAKLQLSKDT YDDDLDNLLA QIGDQYADLF LAAKNLSDAI

301 LLSDILRVNT EITKAPLSAS MIKRYDEHHQ DLTLLKALVR QQLPEKYKEI FFDQSKNGYA

361 GYIDGGASQE EFYKFIKPIL EKMDGTEELL VKLNREDLLR KQRTFDNGSI PHQIHLGELH

421 AILRRQEDFY PFLKDNREKI EKILTFRIPY YVGPLARGNS RFAWMTRKSE ETITPWNFEE

481 VVDKGASAQS FIERMTNFDK NLPNEKVLPK HSLLYEYFTV YNELTKVKYV TEGMRKPAFL

541 SGEQKKAIVD LLFKTNRKVT VKQLKEDYFK KIECFDSVEI SGVEDRFNAS LGTYHDLLKI

601 IKDKDFLDNE ENEDILEDIV LTLTLFEDRE MIEERLKTYA HLFDDKVMKQ LKRRRYTGWG

661 RLSRKLINGI RDKQSGKTIL DFLKSDGFAN RNFMQLIHDD SLTFKEDIQK AQVSGQGDSL

721 HEHIANLAGS PAIKKGILQT VKVVDELVKV MGRHKPENIV IEMARENQTT QKGQKNSRER

781 MKRIEEGIKE LGSQILKEHP VENTQLQNEK LYLYYLQNGR DMYVDQELDI NRLSDYDVDA

841 IVPQSFLKDD SIDNKVLTRS DKNRGKSDNV PSEEVVKKMK NYWRQLLNAK LITQRKFDNL

901 TKAERGGLSE LDKAGFIKRQ LVETRQITKH VAQILDSRMN TKYDENDKLI REVKVITLKS
```

```
 961  KLVSDFRKDF QFYKVREINN YHHAHDAYLN AVVGTALIKK YPKLESEFVY GDYKVYDVRK

1021  MIAKSEQEIG KATAKYFFYS NIMNFFKTEI TLANGEIRKR PLIETNGETG EIVWDKGRDF

1081  ATVRKVLSMP QVNIVKKTEV QTGGFSKESI LPKRNSDKLI ARKKDWDPKK YGGFDSPTVA

1141  YSVLVVAKVE KGKSKKLKSV KELLGITIME RSSFEKNPID FLEAKGYKEV KKDLIIKLPK

1201  YSLFELENGR KRMLASAGEL QKGNELALPS KYVNFLYLAS HYEKLKGSPE DNEQKQLFVE

1261  QHKHYLDEII EQISEFSKRV ILADANLDKV LSAYNKHRDK PIREQAENII HLFTLTNLGA

1321  PAAFKYFDTT IDRKRYTSTK EVLDATLIHQ SITGLYETRI DLSQLGGD.
```

Nuclease inactivated *S. pyogenes* Cas9 proteins may comprise deletion of a RuvC nuclease domain or a portion thereof, an HNH domain, a DNAse active site, a ββα-metal fold or a portion thereof comprising a DNAse active site or any combination thereof.

Other exemplary Cas9 proteins or portions thereof may comprise or consist of the following amino acid sequences.

In some embodiments the Cas9 protein can be *S. pyogenes* Cas9 and may comprise or consist of the amino acid sequence:

(SEQ ID NO: 149)
MDKKYSIGLDIGTNSVGWAVITDEYKVPSKKFKVLGNTDRHSIKKNLIGAL
LFDSGETAEATRLKRTARRRYTRRKNRICYLQEIFSNEMAKVDDSFFHRLE
ESFLVEEDKKHERHPIFGNIVDEVAYHEKYPTIYHLRKKLVDSTDKADLRL
IYLALAHMIKFRGHFLIEGDLNPDNSDVDKLFIQLVQTYNQLFEENPINAS
GVDAKAILSARLSKSRRLENLIAQLPGEKKNGLFGNLIALSLGLTPNFKSN
FDLAEDAKLQLSKDTYDDDLDNLLAQIGDQYADLFLAAKNLSDAILLSDIL
RVNTEITKAPLSASMIKRYDEHHQDLTLLKALVRQQLPEKYKEIFFDQSKN
GYAGYIDGGASQEEFYKFIKPILEKMDGTEELLVKLNREDLLRKQRTFDNG
SIPHQIHLGELHAILRRQEDFYPFLKDNREKIEKILTFRIPYYVGPLARGN
SRFAWMTRKSEETITPWNFEEVVDKGASAQSFIERMTNFDKNLPNEKVLPK
HSLLYEYFTVYNELTKVKYVTEGMRKPAFLSGEQKKAIVDLLFKTNRKVTV
KQLKEDYFKKIECFDSVEISGVEDRFNASLGTYHDLLKIIKDKDFLDNEEN
EDILEDIVLTLTLFEDREMIEERLKTYAHLFDDKVMKQLKRRRYTGWGRLS
RKLINGIRDKQSGKTILDFLKSDGFANRNFMQLIHDDSLTFKEDIQKAQVS
GQGDSLHEHIANLAGSPAIKKGILQTVKVVDELVKVMGRHKPENIVIEMAR
ENQTTQKGQKNSRERMKRIEEGIKELGSQILKEHPVENTQLQNEKLYLYYL
QNGRDMYVDQELDINRLSDYDVDHIVPQSFLKDDSIDNKVLTRSDKNRGKS
DNVPSEEVVKKMKNYWRQLLNAKLITQRKFDNLTKAERGGLSELDKAGFIK
RQLVETRQITKHVAQILDSRMNTKYDENDKLIREVKVITLKSKLVSDFRKD
FQFYKVREINNYHHAHDAYLNAVVGTALIKKYPKLESEFVYGDYKVYDVRK
MIAKSEQEIGKATAKYFFYSNIMNFFKTEITLANGEIRKRPLIETNGETGE
IVWDKGRDFATVRKVLSMPQVNIVKKTEVQTGGFSKESILPKRNSDKLIAR
KKDWDPKKYGGFDSPTVAYSVLVVAKVEKGKSKKLKSVKELLGITIMERSS
FEKNPIDFLEAKGYKEVKKDLIIKLPKYSLFELENGRKRMLASAGELQKGN
ELALPSKYVNFLYLASHYEKLKGSPEDNEQKQLFVEQHKHYLDEIIEQISE
FSKRVILADANLDKVLSAYNKHRDKPIREQAENIIHLFTLTNLGAPAAFKY
FDTTIDRKRYTSTKEVLDATLIHQSITGLYETRIDLSQLGGD

In some embodiments the Cas9 protein can be *S. aureus* Cas9 and may comprise or consist of the amino acid sequence:

(SEQ ID NO: 150)
MKRNYILGLDIGITSVGYGIIDYETRDVIDAGVRLFKEANVENNEGRRSKR
GARRLKRRRRHRIQRVKKLLFDYNLLTDHSELSGINPYEARVKGLSQKLSE
EEFSAALLHLAKRRGVHNVNEVEEDTGNELSTKEQISRNSKALEEKYVAEL
QLERLKKDGEVRGSINRFKTSDYVKEAKQLLKVQKAYHQLDQSFIDTYIDL
LETRRTYYEGPGEGSPFGWKDIKEWYEMLMGHCTYFPEELRSVKYAYNADL
YNALNDLNNLVITRDENEKLEYYEKFQIIENVFKQKKKPTLKQIAKEILVN
EEDIKGYRVTSTGKPEFTNLKVYHDIKDITARKEIIENAELLDQIAKILTI
YQSSEDIQEELTNLNSELTQEEIEQISNLKGYTGTHNLSLKAINLILDELW
HTNDNQIAIFNRLKLVPKKVDLSQQKEIPTTLVDDFILSPVVKRSFIQSIK
VINAIIKKYGLPNDIIIELAREKNSKDAQKMINEMQKRNRQTNERIEEIIR
TTGKENAKYLIEKIKLHDMQEGKCLYSLEAIPLEDLLNNPFNYEVDHIIPR
SVSFDNSFNNKVLVKQEENSKKGNRTPFQYLSSSDSKISYETFKKHILNLA
KGKGRISKTKKEYLLEERDINRFSVQKDFINRNLVDTRYATRGLMNLLRSY
FRVNNLDVKVKSINGGFTSFLRRKWKFKKERNKGYKHHAEDALIIANADFI
FKEWKKLDKAKKVMENQMFEEKQAESMPEIETEQEYKEIFITPHQIKHIKD
FKDYKYSHRVDKKPNRELINDTLYSTRKDDKGNTLIVNNLNGLYDKDNDKL
KKLINKSPEKLLMYHHDPQTYQKLKLIMEQYGDEKNPLYKYYEETGNYLTK
YSKKDNGPVIKKIKYYGNKLNAHLDITDDYPNSRNKVVKLSLKPYRFDVYL
DNGVYKFVTVKNLDVIKKENYYEVNSKCYEEAKKLKKISNQAEFIASFYNN
DLIKINGELYRVIGVNNDLLNRIEVNMIDITYREYLENMNDKRPPRIIKTI
ASKTQSIKKYSTDILGNLYEVKSKKHPQIIKKG

In some embodiments the Cas9 protein can be *S. thermophiles* CRISPR1 Cas9 and may comprise or consist of the amino acid sequence:

(SEQ ID NO: 151)
MSDLVLGLDIGIGSVGVGILNKVTGEIIHKNSRIFPAAQAENNLVRRTNRQ
GRRLARRKKHRRVRLNRLFEESGLITDFTKISINLNPYQLRVKGLTDELSN

```
EELFIALKNMVKHRGISYLDDASDDGNSSVGDYAQIVKENSKQLETKTPGQ

IQLERYQTYGQLRGDFTVEKDGKKHRLINVFPTSAYRSEALRILQTQQEFN

PQITDEFINRYLEILTGKRKYYHGPGNEKSRTDYGRYRTSGETLDNIFGIL

IGKCTFYPDEFRAAKASYTAQEFNLLNDLNNLTVPTETKKLSKEQKNQIIN

YVKNEKAMGPAKLFKYIAKLLSCDVADIKGYRIDKSGKAEIHTFEAYRKMK

TLETLDIEQMDRETLDKLAYVLTLNTEREGIQEALEHEFADGSFSQKQVDE

LVQFRKANSSIFGKGWHNFSVKLMMELIPELYETSEEQMTILTRLGKQKTT

SSSNKTKYIDEKLLTEEIYNPVVAKSVRQAIKIVNAAIKEYGDFDNIVIEM

ARETNEDDEKKAIQKIQKANKDEKDAAMLKAANQYNGKAELPHSVFHGHKQ

LATKIRLWHQQGERCLYTGKTISIHDLINNSNQFEVDHILPLSITFDDSLA

NKVLVYATANQEKGQRTPYQALDSMDDAWSFRELKAFVRESKTLSNKKKEY

LLTEEDISKFDVRKKFIERNLVDTRYASRVVLNALQEHFRAHKIDTKVSVV

RGQFTSQLRRHWGIEKTRDTYHHHAVDALIIAASSQLNLWKKQKNTLVSYS

EDQLLDIETGELISDDEYKESVFKAPYQHFVDTLKSKEFEDSILFSYQVDS

KFNRKISDATIYATRQAKVGKDKADETYVLGKIKDIYTQDGYDAFMKIYKK

DKSKFLMYRHDPQTFEKVIEPILENYPNKQINDKGKEVPCNPPFLKYKEEHG

YIRKYSKKGNGPEIKSLKYYDSKLGNHIDITPKDSNNKVVLQSVSPWRADV

YFNKTTGKYEILGLKYADLQFDKGTGTYKISQEKYNDIKKKEGVDSDSEFK

FTLYKNDLLLVKDTETKEQQLFRFLSRTMPKQKHYVELKPYDKQKFEGGEA

LIKVLGNVANSGQCKKGLGKSNISIYKVRTDVLGNQHIIKNEGDKPKLDF
```

In some embodiments the Cas9 protein can be *N. meningitidis* Cas9 and may comprise or consist of the amino acid sequence:

```
                                    (SEQ ID NO: 152)
MAAFKPNPINYILGLDIGIASVGWAMVEIDEDENPICLIDLGVRVFERAEV

PKTGDSLAMARRLARSVRRLTRRRAHRLLRARRLLKREGVLQAADFDENGL

IKSLPNTPWQLRAAALDRKLTPLEWSAVLLHLIKHRGYLSQRKNEGETADK

ELGALLKGVADNAHALQTGDFRTPAELALNKFEKESGHIRNQRGDYSHTFS

RKDLQAELILLFEKQKEFGNPHVSGGLKEGIETLLMTQRPALSGDAVQKML

GHCTFEPAEPKAAKNTYTAERFIWLTKLNNLRILEQGSERPLTDTERATLM

DEPYRKSKLTYAQARKLLGLEDTAFFKGLRYGKDNAEASTLMEMKAYHAIS

RALEKEGLKDKKSPLNLSPELQDEIGTAFSLFKTDEDITGRLKDRIQPEIL

EALLKHISFDKFVQISLKALRRIVPLMEQGKRYDEACAEIYGDHYGKKNTE

EKIYLPPIPADEIRNPVVLRALSQARKVINGVVRRYGSPARIHIETAREVG

KSFKDRKEIEKRQEENRKDREKAAAKFREYFPNFVGEPKSKDILKLRLYEQ

QHGKCLYSGKEINLGRLNEKGYVEIDHALPFSRTWDDSFNNKVLVLGSENQ

NKGNQTPYEYFNGKDNSREWQEFKARVETSRFPRSKKQRILLQKFDEDGFK

ERNLNDTRYVNRFLCQFVADRMRLTGKGKKRVFASNGQITNLLRGFWGLRK

VRAENDRHHALDAVVVACSTVAMQQKITRFVRYKEMNAFDGKTIDKETGEV

LHQKTHFPQPWEFFAQEVMIRVFGKPDGKPEFEEADTPEKLRTLLAEKLSS

RPEAVHEYVTPLFVSRAPNRKMSGQGHMETVKSAKRLDEGVSVLRVPLTQL

KLKDLEKMVNREREPKLYEALKARLEAHKDDPAKAFAEPPFYKYDKAGNRTQ

QVKAVRVEQVQKTGVWVRNHNGIADNATMVRVDVFEKGDKYYLVPIYSWQV

AKGILPDRAVVQGKDEEDWQLIDDSFNFKFSLHPNDLVEVITKKARMFGYF

ASCHRGTGNINIRIHDLDHKIGKNGILEGIGVKTALSFQKYQIDELGKEIR

PCRLKKRPPVR
```

In some embodiments the Cas9 protein can be *Parvibaculum. lavamentivorans* Cas9 and may comprise or consist of the amino acid sequence:

```
                                    (SEQ ID NO: 153)
MERIFGFDIGTTSIGFSVIDYSSTQSAGNIQRLGVRIFPEARDPDGTPLNQ

QRRQKRMMRRQLRRRIRRKALNETLHEAGFLPAYGSADWPVVMADEPYEL

RRRGLEEGLSAYEFGRAIYHLAQHRHFKGRELEESDTPDPDVDDEKEAANE

RAATLKALKNEQTTLGAWLARRPPSDRKRGIHAHRNVVAEEFERLWEVQSK

FHPALKSEEMRARISDTIFAQRPVFWRKNTLGECRFMPGEPLCPKGSWLSQ

QRRMLEKLNNLAIAGGNARPLDAEERDAILSKLQQQASMSWPGVRSALKAL

YKQRGEPGAEKSLKFNLELGGESKLLGNALEAKLADMFGPDWPAHPRKQEI

RHAVHERLWAADYGETPDKKRVIILSEKDRKAHREAAANSFVADFGITGEQ

AAQLQALKLPTGWEPYSIPALNLFLAELEKGERFGALVNGPDWEGWRRTNF

PHRNQPTGEILDKLPSPASKEERERISQLRNPTVVRTQNELRKVVNNLIGL

YGKPDRIRIEVGRDVGKSKREREEIQSGIRRNEKQRKKATEDLIKNGIANP

SRDDVEKWILWKEGQERCPYTGDQIGFNALFREGRYEVEHIWPRSRSFDNS

PRNKTLCRKDVNIEKGNRMPFEAFGHDEDRWSAIQIRLQGMVSAKGGTGMS

PGKVKRFLAKTMPEDFAARQLNDTRYAAKQILAQLKRLWPDMGPEAPVKVE

AVTGQVTAQLRKLWTLNNILADDGEKTRADHRHHAIDALTVACTHPGMTNK

LSRYWQLRDDPRAEKPALTPPWDTIRADAEKAVSEIVVSHRVRKKVSGPLH

KETTYGDTGTDIKTKSGTYRQFVTRKKIESLSKGELDEIRDPRIKEIVAAH

VAGRGGDPKKAFPPYPCVSPGGPEIRKVRLTSKQQLNLMAQTGNGYADLGS

NHHIAIYRLPDGKADFEIVSLFDASRRLAQRNPIVQRTRADGASFVMSLAA

GEAIMIPEGSKKGIWIVQGVWASGQVVLERDTDADHSTTTRPMPNPILKDD

AKKVSIDPIGRVRPSND
```

In some embodiments the Cas9 protein can be *Corynebacter diphtheria* Cas9 and may comprise or consist of the amino acid sequence:

```
                                    (SEQ ID NO: 154)
MKYHVGIDVGTFSVGLAAIEVDDAGMPIKTLSLVSHIHDSGLDPDEIKSAV

TRLASSGIARRTRRLYRRKRRLQQLDKFIQRQGWPVIELEDYSDPLYPWK

VRAELAASYIADEKERGEKLSVALRHIARHRGWRNPYAKVSSLYLPDGPSD

AFKAIREEIKRASGQPVPETATVGQMVTLCELGTLKLRGEGGVLSARLQQS

DYAREIQEICRMQEIGQELYRKIIDVVFAAESPKGSASSRVGKDPLQPGKN

RALKASDAFQRYRIAALIGNLRVRVDGEKRILSVEEKNLVFDHLVNLTPKK

EPEWVTIAEILGIDRGQLIGTATMTDDGERAGARPPTHDTNRSIVNSRIAP

LVDWWKTASALEQHAMVKALSNAEVDDFDSPEGAKVQAFFADLDDDVHAKL
```

-continued

DSLHLPVGRAAYSEDTLVRLTRRMLSDGVDLYTARLQEFGIEPSWTPPTPR

IGEPVGNPAVDRVLKTVSRWLESATKTWGAPERVIIEHVREGFVTEKRARE

MDGDMRRRAARNAKLFQEMQEKLNVQGKPSRADLWRYQSVQRQNCQCAYCG

SPITFSNSEMDHIVPRAGQGSTNTRENLVAVCHRCNQSKGNTPFAIWAKNT

SIEGVSVKEAVERTRHWVTDTGMRSTDFKKFTKAVVERFQRATMDEEIDAR

SMESVAWMANELRSRVAQHFASHGTTVRVYRGSLTAEARRASGISGKLKFF

DGVGKSRLDRRHHAIDAAVIAFTSDYVAETLAVRSNLKQSQAHRQEAPQWR

EFTGKDAEHRAAWRVWCQKMEKLSALLTEDLRDDRVVVMSNVRLRLGNGSA

HKETIGKLSKVKLSSQLSVSDIDKASSEALWCALTREPGFDPKEGLPANPE

RHIRVNGTHVYAGDNIGLFPVSAGSIALRGGYAELGSSFHHARVYKITSGK

KPAFAMLRVYTIDLLPYRNQDLFSVELKPQTMSMRQAEKKLRDALATGNAE

YLGWLVVDDELVVDTSKIATDQVKAVEAELGTIRRWRVDGFFSPSKLRLRP

LQMSKEGIKKESAPELSKIIDRPGWLPAVNKLFSDGNVTVVRRDSLGRVRL

ESTAHLPVTWKVQ

In some embodiments the Cas9 protein can be *Streptococcus pasteurianus* Cas9 and may comprise or consist of the amino acid sequence:

```
                                      (SEQ ID NO: 155)
MTNGKILGLDIGIASVGVGIIEAKTGKVVHANSRLFSAANAENNAERRGFR

GSRRLNRRKKHRVKRVRDLFEKYGIVTDFRNLNLNPYELRVKGLTEQLKNE

ELFAALRTISKRRGISYLDDAEDDSTGSTDYAKSIDENRRLLKNKTPGQIQ

LERLEKYGQLRGNFTVYDENGEAHRLINVFSTSDYEKEARKILETQADYNK

KITAEFIDDYVEILTQKRKYYHGPGNEKSRTDYGRFRTDGTTLENIFGILI

GKCNFYPDEYRASKASYTAQEYNFLNDLNNLKVSTETGKLSTEQKESLVEF

AKNTATLGPAKLLKEIAKILDCKVDEIKGYREDDKGKPDLHTFEPYRKLKF

NLESINIDDLSREVIDKLADILTLNTEREGIEDAIKRNLPNQFTEEQISEI

IKVRKSQSTAFNKGWHSFSAKLMNELIPELYATSDEQMTILTRLEKFKVNK

KSSKNTKTIDEKEVTDEIYNPVVAKSVRQTIKIINAAVKKYGDFDKIVIEM

PRDKNADDEKKFIDKRNKENKKEKDDALKRAAYLYNSSDKLPDEVFHGNKQ

LETKIRLWYQQGERCLYSGKPISIQELVHNSNNFEIDHILPLSLSFDDSLA

NKVLVYAWTNQEKGQKTPYQVIDSMDAAWSFREMKDYVLKQKGLGKKKRDY

LLTTENIDKIEVKKKFIERNLVDTRYASRVVLNSLQSALRELGKDTKVSVV

RGQFTSQLRRKWKIDKSRETYHHHAVDALIIAASSQLKLWEKQDNPMFVDY

GKNQVVDKQTGEILSVSDDEYKELVFQPPYQGFVNTISSKGFEDEILFSYQ

VDSKYNRKVSDATIYSTRKAKIGKDKKEETYVLGKIKDIYSQNGFDTFIKK

YNKDKTQFLMYQKDSLTWENVIEVILRDYPTTKKSEDGKNDVKCNPFEEYR

RENGLICKYSKKGKGTPIKSLKYYDKKLGNCIDITPEESRNKVILQSINPW

RADVYFNPETLKYELMGLKYSDLSFEKGTGNYHISQEKYDAIKEKEGIGKK

SEFKFTLYRNDLILIKDIASGEQEIYRFLSRTMPNVNHYVELKPYDKEKFD

NVQELVEALGEADKVGRCIKGLNKPNISIYKVRTDVLGNKYFVKKKGDKPK

LDFKNNKK
```

In some embodiments the Cas9 protein can be *Neisseria cinerea* Cas9 and may comprise or consist of the amino acid sequence:

```
                                      (SEQ ID NO: 156)
MAAFKPNPMNYILGLDIGIASVGWAIVEIDEEENPIRLIDLGVRVFERAEV

PKTGDSLAAARRLARSVRRLTRRRAHRLLRARRLLKREGVLQAADFDENGL

IKSLPNTPWQLRAAALDRKLTPLEWSAVLLHLIKHRGYLSQRKNEGETADK

ELGALLKGVADNTHALQTGDFRTPAELALNKFEKESGHIRNQRGDYSHTFN

RKDLQAELNLLFEKQKEFGNPHVSDGLKEGIETLLMTQRPALSGDAVQKML

GHCTFEPTEPKAAKNTYTAERFVWLTKLNNLRILEQGSERPLTDTERATLM

DEPYRKSKLTYAQARKLLDLDDTAFFKGLRYGKDNAEASTLMEMKAYHAIS

RALEKEGLKDKKSPLNLSPELQDEIGTAFSLFKTDEDITGRLKDRVQPEIL

EALLKHISFDKFVQISLKALRRIVPLMEQGNRYDEACTEIYGDHYGKKNTE

EKIYLPPIPADEIRNPVVLRALSQARKVINGVVRRYGSPARIHIETAREVG

KSFKDRKEIEKRQEENRKDREKSAAKFREYFPNFVGEPKSKDILKLRLYEQ

QHGKCLYSGKEINLGRLNEKGYVEIDHALPFSRTWDDSFNNKVLALGSENQ

NKGNQTPYEYFNGKDNSREWQEFKARVETSRFPRSKKQRILLQKFDEDGFK

ERNLNDTRYINRFLCQFVADHMLLTGKGKRRVFASNGQITNLLRGFWGLRK

VRAENDRHHALDAVVVACSTIAMQQKITRFVRYKEMNAFDGKTIDKETGEV

LHQKAHFPQPWEFFAQEVMIRVFGKPDGKPEFEEADTPEKLRTLLAEKLSS

RPEAVHKYVTPLFISRAPNRKMSGQGHMETVKSAKRLDEGISVLRVPLTQL

KLKDLEKMVNEREREPKLYEALKARLEAHKDDPAKAFAEPFYKYDKAGNRTQ

QVKAVRVEQVQKTGVWVHNHNGIADNATIVRVDVFEKGGKYYLVPIYSWQV

AKGILPDRAVVQGKDEEDWTVMDDSFEFKFVLYANDLIKLTAKKNEFLGYF

VSLNRATGAIDIRTHDTDSTKGKNGIFQSVGVKTALSFQKYQIDELGKEIR

PCRLKKRPPVR
```

In some embodiments the Cas9 protein can be *Campylobacter lari* Cas9 and may comprise or consist of the amino acid sequence:

```
                                      (SEQ ID NO: 157)
MRILGFDIGINSIGWAFVENDELKDCGVRIFTKAENPKNKESLALPRRNAR

SSRRRLKRRKARLIAIKRILAKELKLNYKDYVAADGELPKAYEGSLASVYE

LRYKALTQNLETKDLARVILHIAKHRGYMNKNEKKSNDAKKGKILSALKNN

ALKLENYQSVGEYFYKEFFQKYKKNTKNFIKIRNTKDNYNNCVLSSDLEKE

LKLILEKQKEFGYNYSEDFINEILKVAFFQRPLKDFSHLVGACTFFEEEKR

ACKNSYSAWEFVALTKIINEIKSLEKISGEIVPTQTINEVLNLILDKGSIT

YKKFRSCINLHESISFKSLKYDKENAENAKLIDFRKLVEFKKALGVHSLSR

QELDQISTHITLIKDNVKLKTVLEKYNLSNEQINNLLEIEFNDYINLSFKA

LGMILPLMREGKRYDEACEIANLKPKTVDEKKDFLPAFCDSIFAHELSNPV

VNRAISEYRKVLNALLKKYGKVHKIHLELARDVGLSKKAREKIEKEQKENQ

AVNAWALKECENIGLKASAKNILKLKLWKEQKEICIYSGNKISIEHLKDEK

ALEVDHIYPYSRSFDDSFINKVLVFTKENQEKLNKTPFEAFGKNIEKWSKI
```

-continued

QTLAQNLPYKKKNKILDENFKDKQQEDFISRNLNDTRYIATLIAKYTKEYL

NFLLLSENENANLKSGEKGSKIHVQTISGMLTSVLRHTWGFDKKDRNNHLH

HALDAIIVAYSTNSIIKAFSDFRKNQELLKARFYAKELTSDNYKHQVKFFE

PFKSFREKILSKIDEIFVSKPPRKRARRALHKDTFHSENKIIDKCSYNSKE

GLQIALSCGRVRKIGTKYVENDTIVRVDIFKKQNKFYAIPIYAMDFALGIL

PNKIVITGKDKNNNPKQWQTIDESYEFCFSLYKNDLILLQKKNMQEPEFAY

YNDFSISTSSICVEKHDNKFENLTSNQKLLFSNAKEGSVKVESLGIQNLKV

FEKYIITPLGDKIKADFQPRENISLKTSKKYGLR

In some embodiments the Cas9 protein can be *T. denticola* Cas9 and may comprise or consist of the amino acid sequence:

(SEQ ID NO: 158)
MKKEIKDYFLGLDVGTGSVGWAVTDTDYKLLKANRKDLWGMRCFETAET

AEVRRLHRGARRRIERRKKRIKLLQELFSQEIAKTDEGFFQRMKESPFY

AEDKTILQENTLFNDKDFADKTYHKAYPTINHLIKAWIENKVKPDPRLL

YLACHNIIKKRGHFLFEGDFDSENQFDTSIQALFEYLREDMEVDIDADS

QKVKEILKDSSLKNSEKQSRLNKILGLKPSDKQKKAITNLISGNKINFA

DLYDNPDLKDAEKNSISFSKDDFDALSDDLASILGDSFELLLKAKAVYN

CSVLSKVIGDEQYLSFAKVKIYEKHKTDLTKLKNVIKKHFPKDYKKVFG

YNKNEKNNNNYSGYVGVCKTKSKKLIINNSVNQEDFYKFLKTILSAKSE

IKEVNDILIEIETGTFLPKQISKSNAEIPYQLRKMELEKILSNAEKHFS

FLKQKDEKGLSHSEKIIMLLTFKIPYYIGPINDNHKKFFPDRCWVVKKE

KSPSGKTTPWNFFDHIDKEKTAEAFITSRTNFCTYLVGESVLPKSSLLY

SEYTVLNEINNLQIIIDGKNICDIKLKQKIYEDLFKKYKKITQKQISTF

IKHEGICNKTDEVIILGIDKECTSSLKSYIELKNIFGKQVDEISTKNML

EEIIRWATIYDEGEGKTILKTKIKAEYGKYCSDEQIKKILNLKFSGWGR

LSRKFLETVTSEMPGFSEPVNIITAMRETQNNLMELLSSEFTFTENIKK

INSGFEDAEKQFSYDGLVKPLFLSPSVKKMLWQTLKLVKEISHITQAPP

KKIFIEMAKGAELEPARTKTRLKILQDLYNNCKNDADAFSSEIKDLSGK

IENEDNLRLRSDKLYLYYTQLGKCMYCGKPIEIGHVFDTSNYDIDHIYP

QSKIKDDSISNRVLVCSSCNKNKEDKYPLKSEIQSKQRGFWNFLQRNNF

ISLEKLNRLTRATPISDDETAKFIARQLVETRQATKVAAKVLEKMFPET

KIVYSKAETVSMFRNKFDIVKCREINDFHHAHDAYLNIVVGNVYNTKFT

NNPWNFIKEKRDNPKIADTYNYYKVFDYDVKRNNITAWEKGKTIITVKD

MLKRNTPIYTRQAACKKGELFNQTIMKKGLGQHPLKKEGPFSNISKYGG

YNKVSAAYYTLIEYEEKGNKIRSLETIPLYLVKDIQKDQDVLKSYLTDL

LGKKEFKILVPKIKINSLLKINGFPCHITGKTNDSFLLRPAVQFCCSNN

EVLYFKKIIRFSEIRSQREKIGKTISPYEDLSFRSYIKENLWKKTKNDE

IGEKEFYDLLQKKNLEIYDMLLTKHKDTIYKKRPNSATIDILVKGKEKF

KSLIIENQFEVILEILKLFSATRNVSDLQHIGGSKYSGVAKIGNKISSL

DNCILIYQSITGIFEKRIDLLKV

In some embodiments the Cas9 protein can be *S. mutans* Cas9 and may comprise or consist of the amino acid sequence:

(SEQ ID NO: 159)
MKKPYSIGLDIGTNSVGWAVVTDDYKVPAKKMKVLGNTDKSHIEKNLLG

ALLFDSGNTAEDRRLKRTARRRYTRRRNRILYLQEIFSEEMGKVDDSFF

HRLEDSFLVIEDKRGERHPIFGNLEEEVKYHENFPTIYHLRQYLADNPE

KVDLRLVYLALAHIIKFRGHFLIEGKFDTRNNDVQRLFQEFLAVYDNTF

ENSSLQEQNVQVEEILTDKISKSAKKDRVLKLFPNEKSNGRFAEFLKLI

VGNQADFKKHFELEEKAPLQFSKDTYEEELEVLLAQIGDNYAELFLSAK

KLYDSILLSGILTVTDVGTKAPLSASMIQRYNEHQMDLAQLKQFIRQKL

SDKYNEVFSDVSKDGYAGYIDGKTNQEAFYKYLKGLLNKIEGSGYFLDK

IEREDFLRKQRTFDNGSIPHQIHLQEMRAIIRRQAEFYPFLADNQDRIE

KLLTFRIPYYVGPLARGKSDFAWLSRKSADKITPWNFDEIVDKESSAEA

FINRMTNYDLYLPNQKVLPKHSLLYEKFTVYNELTKVKYKTEQGKTAFF

DANMKQEIFDGVFKVYRKVTKDKLMDFLEKEFDEFRIVDLTGLDKENKV

FNASYGTYHDLCKILDKDFLDNSKNEKILEDIVLTLTLFEDREMIRKRL

ENYSDLLTKEQVKKLERRHYTGWGRLSAELIHGIRNKESRKTILDYLID

DGNSNRNFMQLINDDALSFKEEIAKAQVIGETDNLNQVVSDIAGSPAIK

KGILQSLKIVDELVKIMGHQPENIVVEMARENQFTNQGRRNSQQRLKGL

TDSIKEFGSQILKEHPVENSQLQNDRLFLYYLQNGRDMYTGEELDIDYL

SQYDIDHIIPQAFIKDNSIDNRVLTSSKENRGKSDDVPSKDVVRKMKSY

WSKLLSAKLITQRKFDNLTKAERGGLTDDDKAGFIKRQLVETRQITKHV

ARILDERFNTETDENNKKIRQVKIVTLKSNLVSNFRKEFELYKVREIND

YHHAHDAYLNAVIGKALLGVYPQLEPEFVYGDYPHFGHKENKATAKKF

FYSNIMNFFKKDDVRTDKNGEIIWKKDEHISNIKKVLSYPQVNIVKKVE

EQTGGFSKESILPKGNSDKLIPRKTKKFYWDTKKYGGFDSPIVAYSILV

IADIEKGKSKKLKTVKALVGVTIMEKMTFERDPVAFLERKGYRNVQEEN

IIKLPKYSLFKLENGRKRLLASARELQKGNEIVLPNHLGTLLYHAKNIH

KVDEPKHLDYVDKHKDEFKELLDVVSNFSKKYTLAEGNLEKIKELYAQN

NGEDLKELASSFINLLTFTAIGAPATFKFFDKNIDRKRYTSTTEILNAT

LIHQSITGLYETRIDLNKLGGD

In some embodiments the Cas9 protein can be *S. thermophilus* CRISPR 3 Cas9 and may comprise or consist of the amino acid sequence:

(SEQ ID NO: 160)
MTKPYSIGLDIGTNSVGWAVTTDNYKVPSKKMKVLGNTSKKYIKKNLLG

VLLFDSGITAEGRRLKRTARRRYTRRRNRILYLQEIFSTEMATLDDAFF

QRLDDSFLVPDDKRDSKYPIFGNLVEEKAYHDEFPTIYHLRKYLADSTK

KADLRLVYLALAHMIKYRGHFLIEGEFNSKNNDIQKNFQDFLDTYNAIF

ESDLSLENSKQLEEIVKDKISKLEKKDRILKLFPGEKNSGIFSEFLKLI

VGNQADFRKCFNLDEKASLHFSKESYDEDLETLLGYIGDDYSDVFLKAK

```
KLYDAILLSGFLTVTDNETEAPLSSAMIKRYNEHKEDLALLKEYIRNIS

LKTYNEVFKDDTKNGYAGYIDGKTNQEDFYVYLKKLLAEFEGADYFLEK

IDREDFLRKQRTFDNGSIPYQIHLQEMRAILDKQAKFYPFLAKNKERIE

KILTFRIPYYVGPLARGNSDFAWSIRKRNEKITPWNFEDVIDKESSAEA

FINRMTSFDLYLPEEKVLPKHSLLYETFNVYNELTKVRFIAESMRDYQF

LDSKQKKDIVRLYFKDKRKVTDKDIIEYLHAIYGYDGIELKGIEKQFNS

SLSTYHDLLNIINDKEFLDDSSNEAIIEEIIHTLTIFEDREMIKQRLSK

FENIFDKSVLKKLSRRHYTGWGKLSAKLINGIRDEKSGNTILDYLIDDG

ISNRNFMQLIHDDALSFKKKIQKAQIIGDEDKGNIKEVVKSLPGSPAIK

KGILQSIKIVDELVKVMGGRKPESIVVEMARENQYTNQGKSNSQQRLKR

LEKSLKELGSKILKENIPAKLSKIDNNALQNDRLYLYYLQNGKDMYTGD

DLDIDRLSNYDIDHIIPQAFLKDNSIDNKVLVSSASNRGKSDDVPSLEV

VKKRKTFWYQLLKSKLISQRKFDNLTKAERGGLSPEDKAGFIQRQLVET

RQITKHVARLLDEKFNNKKDENNRAVRTVKIITLKSTLVSQFRKDFELY

KVREINDFHHAHDAYLNAVVASALLKKYPKLEPEFVYGDYPKYNSFRER

KSATEKVYFYSNIMNIFKKSISLADGRVIERPLIEVNEETGESVWNKES

DLATVRRVLSYPQVNVVKKVEEQNHGLDRGKPKGLFNANLSSKPKPNSN

ENLVGAKEYLDPKKYGGYAGISNSFTVLVKGTIEKGAKKKITNVLEFQG

ISILDRINYRKDKLNFLLEKGYKDIELIIELPKYSLFELSDGSRRMLAS

ILSTNNKRGEIHKGNQIFLSQKFVKLLYHAKRISNTINENHRKYVENHK

KEFEELFYYILEFNENYVGAKKNGKLLNSAFQSWQNHSIDELCSSFIGP

TGSERKGLFELTSRGSAADFEFLGVKIPRYRDYTPSSLLKDATLIHQSV

TGLYETRIDLAKLGEG
```

In some embodiments the Cas9 protein can be *C. jejuni* Cas9 and may comprise or consist of the amino acid sequence:

```
                                  (SEQ ID NO: 161)
MARILAFDIGISSIGWAFSENDELKDCGVRIFTKVENPKTGESLALPRR

LARSARKRLARRKARLNHLKHLIANEFKLNYEDYQSFDESLAKAYKGSL

ISPYELRFRALNELLSKQDFARVILHIAKRRGYDDIKNSDDKEKGAILK

AIKQNEEKLANYQSVGEYLYKEYFQKFKENSKEFTNVRNKKESYERCIA

QSFLKDELKLIFKKQREFGFSFSKKFEEEVLSVAFYKRALKDFSHLVGN

CSFFTDEKRAPKNSPLAFWVALTRIINLLNNLKNTEGILYTKDDLNALL

NEVLKNGTLTYKQTKKLLGLSDDYEFKGEKGTYFIEFKKYKEFIKALGE

HNLSQDDLNEIAKDITLIKDEIKLKKALAKYDLNQNQIDSLSKLEFKDH

LNISFKALKLVTPLMLEGKKYDEACNELNLKVAINEDKKDFLPAFNETY

YKDEVTNPVVLRAIKEYRKVLNALLKKYGKVHKINIELAREVGKNHSQR

AKIEKEQNENYKAKKDAELECEKLGLKINSKNILKLRLFKEQKEFCAYS

GEKIKISDLQDEKMLEIDHIYPYSRSFDDSYMNKVLVFTKQNQEKLNQT

PFEAFGNDSAKWQKIEVLAKNLPTKKQKRILDKNYKDKEQKNFKDRNLN

DTRYIARLVLNYTKDYLDFLPLSDDENTKLNDTQKGSKVHVEAKSGMLT

SALRHTWGFSAKDRNNHLHHAIDAVIIAYANNSIVKAFSDFKKEQESNS

AELYAKKISELDYKNKRKFFEPFSGFRQKVLDKIDEIFVSKPERKKPSG

ALHEETFRKEEEFYQSYGGKEGVLKALELGKIRKVNGKIVKNGDMFRVD

IFKHKKTNKFYAVPIYTMDFALKVLPNKAVARSKKGEIKDWILMDENYE

FCFSLYKDSLILIQTKDMQEPEFVYYNAFTSSTVSLIVSKHDNKFETLS

KNQKILFKNANEKEVIAKSIGIQNLKVFEKYIVSALGEVTKAEFRQRED

FKK
```

In some embodiments the Cas9 protein can be *P. multocida* Cas9 and may comprise or consist of the amino acid sequence:

```
                                  (SEQ ID NO: 162)
MQTTNLSYILGLDLGIASVGWAVVEINENEDPIGLIDVGVRIFERAEVP

KTGESLALSRRLARSTRRLIRRRAHRLLLAKRFLKREGILSTIDLEKGL

PNQAWELRVAGLERRLSAIEWGAVLLHLIKHRGYLSKRKNESQTNNKEL

GALLSGVAQNHQLLQSDDYRTPAELALKKFAKEEGHIRNQRGAYTHTFN

RLDLLAELNLLFAQQHQFGNPHCKEHIQQYMTELLMWQKPALSGEAILK

MLGKCTHEKNEFKAAKHTYSAERFVWLTKLNNLRILEDGAERALNEEER

QLLINHPYEKSKLTYAQVRKLLGLSEQAIFKHLRYSKENAESATFMELK

AWHAIRKALENQGLKDTWQDLAKKPDLLDEIGTAFSLYKTDEDIQQYLT

NKVPNSVINALLVSLNFDKFIELSLKSLRKILPLMEQGKRYDQACREIY

GHHYGEANQKTSQLLPAIPAQEIRNPVVLRTLSQARKVINAIIRQYGSP

ARVHIETGRELGKSFKERREIQKQQEDNRTKRESAVQKFKELFSDFSSE

PKSKDILKFRLYEQQHGKCLYSGKEINIHRLNEKGYVEIDHALPFSRTW

DDSFNNKVLVLASENQNKGNQTPYEWLQGKINSERWKNFVALVLGSQCS

AAKKQRLLTQVIDDNKFIDRNLNDTRYIARFLSNYIQENLLLVGKNKKN

VFTPNGQITALLRSRWGLIKARENNNRHHALDAIVVACATPSMQQKITR

FIRFKEVHPYKIENRYEMVDQESGEIISPHFPEPWAYFRQEVNIRVFDN

HPDTVLKEMLPDRPQANHQFVQPLFVSRAPTRKMSGQGHMETIKSAKRL

AEGISVLRIPLTQLKPNLLENMVNKEREPALYAGLKARLAEFNQDPAKA

FATPFYKQGGQQVKAIRVEQVQKSGVLVRENNGVADNASIVRTDVFIKN

NKFFLVPIYTWQVAKGILPNKAIVAHKNEDEWEEMDEGAKFKFSLFPND

LVELKTKKEYFFGYYIGLDRATGNISLKEHDGEISKGKDGVYRVGVKLA

LSFEKYQVDELGKNRQICRPQQRQPVR
```

In some embodiments the Cas9 protein can be *F. novicida* Cas9 and may comprise or consist of the amino acid sequence:

```
                                  (SEQ ID NO: 163)
MNFKILPIAIDLGVKNTGVFSAFYQKGTSLERLDNKNGKVYELSKDSYT

LLMNNRTARRHQRRGIDRKQLVKRLFKLIWTEQLNLEWDKDTQQAISFL

FNRRGFSFITDGYSPEYLNIVPEQVKAILMDIFDDYNGEDDLDSYLKLA

TEQESKISEIYNKLMQKILEFKLMKLCTDIKDDKVSTKTLKEITSYEFE

LLADYLANYSESLKTQKFSYTDKQGNLKELSYYHHDKYNIQEFLKRHAT
```

INDRILDTLLTDDLDIWNFNFEKFDFDKNEEKLQNQEDKDHIQAHLHHF

VFAVNKIKSEMASGGRHRSQYFQEITNVLDENNHQEGYLKNFCENLHNK

KYSNLSVKNLVNLIGNLSNLELKPLRKYFNDKIHAKADHWDEQKFIETY

CHWILGEWRVGVKDQDKKDGAKYSYKDLCNELKQKVTKAGLVDFLLELD

PCRTIPPYLDNNNRKPPKCQSLILNPKFLDNQYPNWQQYLQELKKLQSI

QNYLDSFETDLKVLKSSKDQPYFVEYKSSNQQIASGQRDYKDLDARILQ

FIFDRVKASDELLLNEIYFQAKKLKQKASSELEKLESSKKLDEVIANSQ

LSQILKSQHTNGIFEQGTFLHLVCKYYKQRQRARDSRLYIMPEYRYDKK

LHKYNNTGRFDDDNQLLTYCNHKPRQKRYQLLNDLAGVLQVSPNFLKDK

IGSDDDLFISKWLVEHIRGFKKACEDSLKIQKDNRGLLNHKINIARNTK

GKCEKEIFNLICKIEGSEDKKGNYKHGLAYELGVLLFGEPNEASKPEFD

RKIKKFNSIYSFAQIQQIAFAERKGNANTCAVCSADNAHRMQQIKIIEP

VEDNKDKIILSAKAQRLPAIPTRIVDGAVKKMATILAKNIVDDNWQNIK

QVLSAKHQLHIPIIIESNAFEFEPALADVKGKSLKDRRKKALERISPEN

IFKDKNNRIKEFAKGISAYSGANLTDGDFDGAKEELDHIIPRSHKKYGT

LNDEANLICVTRGDNKNKGNRIFCLRDLADNYKLKQFETTDDLEIEKKI

ADTIWDANKKDFKFGNYRSFINLTPQEQKAFRHALFLADENPIKQAVIR

AINNRNRTFVNGTQRYFAEVLANNIYLRAKKENLNTDKISFDYFGIPTI

GNGRGIAEIRQLYEKVDSDIQAYAKGDKPQASYSHLIDAMLAFCIAADE

HRNDGSIGLEIDKNYSLYPLDKNTGEVFTKDIFSQIKITDNEFSDKKLV

RKKAIEGFNTHRQMTRDGIYAENYLPILIHKELNEVRKGYTWKNSEEIK

IFKGKKYDIQQLNNLVYCLKFVDKPISIDIQISTLEELRNILTTNNIAA

TAEYYYINLKTQKLHEYYIENYNTALGYKKYSKEMEFLRSLAYRSERVK

IKSIDDVKQVLDKDSNFIIGKITLPFKKEWQRLYREWQNTTIKDDYEFL

KSFFNVKSITKLHKKVRKDFSLPISTNEGKFLVKRKTWDNNFIYQILND

SDSRADGTKPFIPAFDISKNEIVEAIIDSFTSKNIFWLPKNIELQKVDN

KNIFAIDTSKWFEVETPSDLRDIGIATIQYKIDNNSRPKVRVKLDYVID

DDSKINYFMNHSLLKSRYPDKVLEILKQSTIIEFESSGFNKTIKEMLGM

KLAGIYNETSNN

In some embodiments the Cas9 protein can be *Lactobacillus buchneri* Cas9 and may comprise or consist of the amino acid sequence:

(SEQ ID NO: 164)
MKVNNYHIGLDIGTSSIGWVAIGKDGKPLRVKGKTAIGARLFQEGNPAA

DRRMFRTTRRRLSRRKWRLKLLEEIFDPYITPVDSTFFARLKQSNLSPK

DSRKEFKGSMLFPDLTDMQYHKNYPTIYHLRHALMTQDKKFDIRMVYLA

IHHIVKYRGNFLNSTPVDSFKASKVDFVDQFKKLNELYAAINPEESFKI

NLANSEDIGHQFLDPSIRKFDKKKQIPKIVPVMMNDKVTDRLNGKIASE

IIHAILGYKAKLDVVLQCTPVDSKPWALKFDDEDIDAKLEKILPEMDEN

QQSIVAILQNLYSQVTLNQIVPNGMSLSESMIEKYNDHHDHLKLYKKLI

DQLADPKKKAVLKKAYSQYVGDDGKVIEQAEFWSSVKKNLDDSELSKQI

MDLIDAEKFMPKQRTSQNGVIPHQLHQRELDEIIEHQSKYYPWLVEINP

NKHDLHLAKYKIEQLVAFRVPYYVGPMITPKDQAESAETVFSWMERKGT

ETGQITPWNFDEKVDRKASANRFIKRMTTKDTYLIGEDVLPDESLLYEK

FKVLNELNMVRVNGKLLKVADKQAIFQDLFENYKHVSVKKLQNYIKAKT

GLPSDPEISGLSDPEHFNNSLGTYNDFKKLFGSKVDEPDLQDDFEKIVE

WSTVFEDKKILREKLNEITWLSDQQKDVLESSRYQGWGRLSKKLLTGIV

NDQGERIIDKLWNTNKNFMQIQSDDDFAKRIHEANADQMQAVDVEDVLA

DAYTSPQNKKAIRQVVKVVDDIQKAMGGVAPKYISIEFTRSEDRNPRRT

ISRQRQLENTLKDTAKSLAKSINPELLSELDNAAKSKKGLTDRLYLYFT

QLGKDIYTGEPINIDELNKYDIDHILPQAFIKDNSLDNRVLVLTAVNNG

KSDNVPLRMFGAKMGHFWKQLAEAGLISKRKLKNLQTDPDTISKYAMHG

FIRRQLVETSQVIKLVANILGDKYRNDDTKIIEITARMNHQMRDEFGFI

KNREINDYHHAFDAYLTAFLGRYLYHRYIKLRPYFVYGDFKKFREDKVT

MRNFNFLHDLTDDTQEKIADAETGEVIWDRENSIQQLKDVYHYKFMLIS

HEVYTLRGAMFNQTVYPASDAGKRKLIPVKADRPVNVYGGYSGSADAYM

AIVRIHNKKGDKYRVVGVPMRALDRLDAAKNVSDADFDRALKDVLAPQL

TKTKKSRKTGEITQVIEDFEIVLGKVMYRQLMIDGDKKFMLGSSTYQYN

AKQLVLSDQSVKTLASKGRLDPLQESMDYNNVY1EILDKVNQYFSLYDM

NKFRHKLNLGFSKFISFPNHNVLDGNTKVSSGKREILQEILNGLHANPT

FGNLKDVGITTPFGQLQQPNGILLSDETKIRYQSPTGLFERTVSLKDL

In some embodiments the Cas9 protein can be *Listeria innocua* Cas9 and may comprise or consist of the amino acid sequence:

(SEQ ID NO: 165)
MKKPYTIGLDIGTNSVGWAVLTDQYDLVKRKMKIAGDSEKKQIKKNFWG

VRLFDEGQTAADRRMARTARRRIERRRNRISYLQGIFAEEMSKTDANFF

CRLSDSFYVDNEKRNSRHPFFATIEEEVEYHKNYPTIYHLREELVNSSE

KADLRLVYLALAHIIKYRGNFLIEGALDTQNTSVDGIYKQFIQTYNQVF

ASGIEDGSLKKLEDNKDVAKILVEKVTRKEKLERILKLYPGEKSAGMFA

QFISLIVGSKGNFQKPFDLIEKSDIECAKDSYEEDLESLLALIGDEYAE

LFVAAKNAYSAVVLSSIITVAETETNAKLSASMIERFDTHEEDLGELKA

FIKLHLPKHYEEIFSNTEKHGYAGYIDGKTKQADFYKYMKMTLENIEGA

DYFIAKIEKENFLRKQRTFDNGAIPHQLHLEELEAILHQQAKYYPFLKE

NYDKIKSLVTFRIPYFVGPLANGQSEFAWLTRKADGEIRPWNIEEKVDF

GKSAVDFIEKMTNKDTYLPKENVLPKHSLCYQKYLVYNELTKVRYINDQ

GKTSYFSGQEKEQIFNDLFKQKRKVKKKDLELFLRNMSHVESPTIEGLE

DSFNSSYSTYHDLLKVGIKQEILDNPVN1EMLENIVKILTVFEDKRMIK

EQLQQFSDVLDGVVLKKLERRHYTGWGRLSAKLLMGIRDKQSHLTILDY

LMNDDGLNRNLMQLINDSNLSFKSIIEKEQVTTADKDIQSIVADLAGSP

AIKKGILQSLKIVDELVSVMGYPPQTIVVEMARENQTTGKGKNNSRPRY

KSLEKAIKEFGSQILKEHPTDNQELRNNRLYLYYLQNGKDMYTGQDLDI

HNLSNYDIDHIVPQSFITDNSIDNLVLTSSAGNREKGDDVPPLEIVRKR

KVFWEKLYQGNLMSKRKFDYLTKAERGGLTEADKARFIHRQLVETRQIT

KNVANILHQRFNYEKDDHGNTMKQVRIVTLKSALVSQFRKQFQLYKVRD

VNDYHHAHDAYLNGVVANTLLKVYPQLEPEFVYGDYHQFDWFKANKATA

KKQFYTNIMLFFAQKDRIIDENGEILWDKKYLDTVKKVMSYRQMNIVKK

IEIQKGEFSKATIKPKGNSSKLIPRKTNWDPMKYGGLDSPNMAYAVVIE

YAKGKNKLVFEKKIIRVTIMERKAFEKDEKAFLEEQGYRQPKVLAKLPK

YTLYECEEGRRRMLASANEAQKGNQQVLPNHLVTLLHHAANCEVSDGKS

LDYIESNREMFAELLAHVSEFAKRYTLAEANLNKINQLFEQNKEGDIKA

IAQSFVDLMAFNAMGAPASFKFFETTIERKRYNNLKELLNSTIIYQSIT

GLYESRKRLDD

In some embodiments the Cas9 protein can be *L. pneumophilia* Cas9 and may comprise or consist of the amino acid sequence:

(SEQ ID NO: 166)
MESSQILSPIGIDLGGKFTGVCLSHLEAFAELPNHANTKYSVILIDHNN

FQLSQAQRRATRHRVRNKKRNQFVKRVALQLFQHILSRDLNAKEETALC

HYLNNRGYTYVDTDLDEYIKDETTINLLKELLPSESEHNFIDWFLQKMQ

SSEFRKILVSKVEEKKDDKELKNAVKNIKNFITGFEKNSVEGHRHRKVY

FENIKSDITKDNQLDSIKKKIPSVCLSNLLGHLSNLQWKNLHRYLAKNP

KQFDEQTFGNEFLRMLKNFRHLKGSQESLAVRNLIQQLEQSQDYISILE

KTPPEITIPPYEARTNTGMEKDQSLLLNPEKLNNLYPNWRNLIPGIIDA

HPFLEKDLEHTKLRDRKRIISPSKQDEKRDSYILQRYLDLNKKIDKFKI

KKQLSFLGQGKQLPANLIETQKEMETHFNSSLVSVLIQIASAYNKERED

AAQGIWFDNAFSLCELSNINPPRKQKILPLLVGAILSEDFINNKDKWAK

FKIFWNTHKIGRTSLKSKCKEIEEARKNSGNAFKIDYEEALNHPEHSNN

KALIKIIQTIPDIIQAIQSHLGHNDSQALIYHNPFSLSQLYTILETKRD

GFHKNCVAVTCENYWRSQKTEIDPEISYASRLPADSVRPFDGVLARMMQ

RLAYEIAMAKWEQIKHIPDNSSLLIPIYLEQNRFEFEESFKKIKGSSSD

KTLEQAIEKQNIQWEEKFQRIINASMNICPYKGASIGGQGEIDHIYPRS

LSKKHFGVIFNSEVNLIYCSSQGNREKKEEHYLLEHLSPLYLKHQFGTD

NVSDIKNFISQNVANIKKYISFHLLTPEQQKAARHALFLDYDDEAFKTI

TKFLMSQQKARVNGTQKFLGKQIMEFLSTLADSKQLQLEFSIKQITAEE

VHDHRELLSKQEPKLVKSRQQSFPSHAIDATLTMSIGLKEFPQFSQELD

NSWFINHLMPDEVHLNPVRSKEKYNKPNISSTPLFKDSLYAERFIPVVV

VKGETFAIGFSEKDLFEIKPSNKEKLFTLLKTYSTKNPGESLQELQAKS

KAKWLYFPINKTLALEFLHHYFHKEIVTPDDTTVCHFINSLRYYTKKES

ITVKILKEPMPVLSVKFESSKKNVLGSFKHTIALPATKDWERLFNHPNF

LALKANPAPNPKEFNEFIRKYFLSDNNPNSDIPNNGHNIKPQKHKAVRK

VFSLPVIPGNAGTMMRIRRKDNKGQPLYQLQTIDDTPSMGIQINEDRLV

KQEVLMDAYKTRNLSTIDGINNSEGQAYATFDNWLTLPVSTFKPEIIKL

EMKPHSKTRRYIRITQSLADFIKTIDEALMIKPSDSIDDPLNMPNEIVC

KNKLFGNELKPRDGKMKIVSTGKIVTYEFESDSTPQWIQTLYVTQLKKQ

P

In some embodiments the Cas9 protein can be *N. lactamica* Cas9 and may comprise or consist of the amino acid sequence:

(SEQ ID NO: 167)
MAAFKPNPMNYILGLDIGIASVGWAMVEVDEEENPIRLIDLGVRVFERA

EVPKTGDSLAMARRLARSVRRLTRRRAHRLLRARRLLKREGVLQDADFD

ENGLVKSLPNTPWQLRAAALDRKLTCLEWSAVLLHLVKHRGYLSQRKNE

GETADKELGALLKGVADNAHALQTGDFRTPAELALNKFEKESGHIRNQR

GDYSHTFSRKDLQAELNLLFEKQKEFGNPHVSDGLKEDIETLLMAQRPA

LSGDAVQKMLGHCTFEPAEPKAAKNTYTAERFIWLTKLNNLRILEQGSE

RPLTDTERATLMDEPYRKSKLTYAQARKLLGLEDTAFFKGLRYGKDNAE

ASTLMEMKAYHAISRALEKEGLKDKKSPLNLSTELQDEIGTAFSLFKTD

KDITGRLKDRVQPEILEALLKHISFDKFVQISLKALRRIVPLMEQGKRY

DEACAEIYGDHYCKKNAEEKIYLPPIPADEIRNPVVLRALSQARKVINC

VVRRYGSPARIHIETAREVGKSFKDRKEIEKRQEENRKDREKAAAKFRE

YFPNFVGEPKSKDILKLRLYEQQHGKCLYSGKEINLVRLNEKGYVEIDH

ALPFSRTWDDSFNNKVLVLGSENQNKGNQTPYEYFNGKDNSREWQEFKA

RVETSRFPRSKKQRILLQKFDEEGFKERNLNDTRYVNRFLCQFVADHIL

LTGKGKRRVFASNGQITNLLRGFWGLRKVRIENDRHHALDAVVVACSTV

AMQQKITRFVRYKEMNAFDGKTIDKETGEVLHQKAHFPQPWEFFAQEVM

IRVFGKPDGKPEFEEADTPEKLRTLLAEKLSSRPEAVHEYVTPLFVSRA

PNRKMSGQGHMETVKSAKRLDEGISVLRVPLTQLKLKGLEKMVNREREP

KLYDALKAQLETHKDDPAKAFAEPFYKYDKAGSRTQQVKAVRIEQVQKT

GVVVVRNHNGIADNATMVRVDVFEKGGKYYLVPIYSWQVAKGILPDRAV

VAFKDEEDWTVMDDSFEFRFVLYANDLIKLTAKKNEFLGYFVSLNRATG

AIDIRTHDTDSTKGKNGIFQSVGVKTALSFQKNQIDELGKEIRPCRLKK

RPPVR

In some embodiments the Cas9 protein can be *N. meningitides* Cas9 and may comprise or consist of the amino acid sequence:

(SEQ ID NO: 168)
MAAFKPNPINYILGLDIGIASVGWAMVEIDEDENPICLIDLGVRVFERA

EVPKTGDSLAMARRLARSVRRLTRRRAHRLLRARRLLKREGVLQAADFD

ENGLIKSLPNTPWQLRAAALDRKLTPLEWSAVLLHLIKHRGYLSQRKNE

GETADKELGALLKGVADNAHALQTGDFRTPAELALNKFEKESGHIRNQR

GDYSHTFSRKDLQAELILLFEKQKEFGNPHVSGGLKEGIETLLMTQRPA

LSGDAVQKMLGHCTFEPAEPKAAKNTYTAERFIWLTKLNNLRILEQGSE

RPLTDTERATLMDEPYRKSKLTYAQARKLLGLEDTAFFKGLRYGKDNAE

-continued

```
ASTLMEMKAYHAISRALEKEGLKDKKSPLNLSPELQDEIGTAFSLFKTD

EDITGRLKDRIQPEILEALLKHISFDKFVQISLKALRRIVPLMEQGKRY

DEACAEIYGDHYGKKNTEEKIYLPPIPADEIRNPVVLRALSQARKVING

VVRRYGSPARIHIETAREVGKSFKDRKEIEKRQEENRKDREKAAAKFRE

YFPNFVGEPKSKDILKLRLYEQQHGKCLYSGKEINLGRLNEKGYVEIDH

ALPFSRTWDDSFNNKVLVLGSENQNKGNQTPYEYFNGKDNSREWQEFKA

RVETSRFPRSKKQRILLQKFDEDGFKERNLNDTRYVNRFLCQFVADRMR

LTGKGKKRVFASNGQITNLLRGFWGLRKVRAENDRHHALDAVVVACSTV

AMQQKITRFVRYKEMNAFDGKTIDKETGEVLHQKTHFPQPWEFFAQEVM

IRVFGKPDGKPEFEEADTPEKLRTLLAEKLSSRPEAVHEYVTPLFVSRA

PNRKMSGQGHMETVKSAKRLDEGVSVLRVPLTQLKLKDLEKMVNREREP

KLYEALKARLEAHKDDPAKAFAEPFYKYDKAGNRTQQVKAVRVEQVQKT

GVVVVRNHNGIADNATMVRVDVFEKGDKYYLVPIYSWQVAKGILPDRAV

VQGKDEEDWQLIDDSFNFKFSLHPNDLVEVITKKARMFGYFASCHRGTG

NINIRIHDLDHKIGKNGILEGIGVKTALSFQKYQIDELGKEIRPCRLKK

RPPVR
```

In some embodiments the Cas9 protein can be *B. longum* Cas9 and may comprise or consist of the amino acid sequence:

```
                                 (SEQ ID NO: 169)
MLSRQLLGASHLARPVSYSYNVQDNDVHCSYGERCFMRGKRYRIGIDVG

LNSVGLAAVEVSDENSPVRLLNAQSVIHDGGVDPQKNKEAITRKNMSGV

ARRTRRMRRRKRERLHKLDMLLGKFGYPVIEPESLDKPFEEWHVRAELA

TRYIEDDELRRESISIALRHMARHRGWRNPYRQVDSLISDNPYSKQYGE

LKEKAKAYNDDATAAEEESTPAQLVVAMLDAGYAEAPRLRWRTGSKKPD

AEGYLPVRLMQEDNANELKQIFRVQRVPADEWKPLFRSVFYAVSPKGSA

EQRVGQDPLAPEQARALKASLAFQEYRIANVITNLRIKDASAELRKLTV

DEKQSIYDQLVSPSSEDITWSDLCDFLGFKRSQLKGVGSLTEDGEERIS

SRPPRLTSVQRIYESDNKIRKPLVAWWKSASDNEHEAMIRLLSNTVDID

KVREDVAYASAIEFIDGLDDDALTKLDSVDLPSGRAAYSVETLQKLTRQ

MLTTDDDLHEARKTLFNVTDSWRPPADPIGEPLGNPSVDRVLKNVNRYL

MNCQQRWGNPVSVNIEHVRSSFSSVAFARKDKREYEKNNEKRSIFRSSL

SEQLRADEQMEKVRESDLRRLEAIQRQNGQCLYCGRTITFRTCEMDHIV

PRKGVGSTNTRTNFAAVCAECNRMKSNTPFAIWARSEDAQTRGVSLAEA

KKRVTMFTFNPKSYAPREVKAFKQAVIARLQQTEDDAAIDNRSIESVAW

MADELHRRIDWYFNAKQYVNSASIDDAEAETMKTTVSVFQGRVTASARR

AAGIEGKIHFIGQQSKTRLDRRHHAVDASVIAMMNTAAAQTLMERESLR

ESQRLIGLMPGERSWKEYPYEGTSRYESFHLWLDNMDVLLELLNDALDN

DRIAVMQSQRYVLGNSIAHDATIHPLEKVPLGSAMSADLIRRASTPALW

CALTRLPDYDEKEGLPEDSHREIRVHDTRYSADDEMGFFASQAAQIAVQ

EGSADIGSAIHHARVYRCWKTNAKGVRKYFYGMIRVFQTDLLRACHDDL

FTVPLPPQSISMRYGEPRVVQALQSGNAQYLGSLVVGDEIEMDFSSLDV

DGQIGEYLQFFSQFSGGNLAWKHWVVDGFFNQTQLRIRPRYLAAEGLAK

AFSDDVVPDGVQKIVTKQGWLPPVNTASKTAVRIVRRNAFGEPRLSSAH

HMPCSWQWRHE
```

In some embodiments the Cas9 protein can be *A. muciniphila* Cas9 and may comprise or consist of the amino acid sequence:

```
                                 (SEQ ID NO: 170)
MSRSLTFSFDIGYASIGWAVIASASHDDADPSVCGCGTVLFPKDDCQAF

KRREYRRLRRNIRSRRVRIERIGRLLVQAQIITPEMKETSGHPAPFYLA

SEALKGHRTLAPIELWHVLRWYAHNRGYDNNASWSNSLSEDGGNGEDTE

RVKHAQDLMDKHGTATMAETICRELKLEEGKADAPMEVSTPAYKNLNTA

FPRLIVEKEVRRILELSAPLIPGLTAEIIELIAQHHPLTTEQRGVLLQH

GIKLARRYRGSLLFGQLIPRFDNRIISRCPVTWAQVYEAELKKGNSEQS

ARERAEKLSKVPTANCPEFYEYRMARILCNIRADGEPLSAEIRRELMNQ

ARQEGKLTKASLEKAISSRLGKEIETNVSNYFTLHPDSEEALYLNPAVE

VLQRSGIGQILSPSVYRIAANRLRRGKSVTPNYLLNLLKSRGESGEALE

KKIEKESKKKEADYADTPLKPKYATGRAPYARTVLKKVVEEILDGEDPT

RPARGEAHPDGELKAHDGCLYCLLDTDSSVNQHQKERRLDTMTNNHLVR

HRMLILDRLLKDLIQDFADGQKDRISRVCVEVGKELTTFSAMDSKKIQR

ELTLRQKSHTDAVNRLKRKLPGKALSANLIRKCRIAMDMNWTCPFTGAT

YGDHELENLELEHIVPHSFRQSNALSSLVLTWPGVNRMKGQRTGYDFVE

QEQENPVPDKPNLHICSLNNYRELVEKLDDKKGHEDDRRRKKKRKALLM

VRGLSHKHQSQNHEAMKEIGMIEGMMTQSSHLMKLACKSIKTSLPDAHI

DMIPGAVTAEVRKAWDVFGVFKELCPEAADPDSGKILKENLRSLTHLHH

ALDACVLGLIPYIIPAHHNGLLRRVLAMRRIPEKLIPQVRPVANQRHYV

LNDDGRMMLRDLSASLKENIREQLMEQRVIQHVPADMGGALLKETMQRV

LSVDGSGEDAMVSLSKKKDGKKEKNQVKASKLVGVFPEGPSKLKALKAA

IEIDGNYGVALDPKPVVIRHIKVFKRIMALKEQNGGKPVRILKKGMLIH

LTSSKDPKHAGVVVRIESIQDSKGGVKLDLQRAHCAVPKNKTHECNWRE

VDLISLLKKYQMKRYPTSYTGTPR
```

In some embodiments the Cas9 protein can be *O. laneus* Cas9 and may comprise or consist of the amino acid sequence:

```
                                 (SEQ ID NO: 171)
METTLGIDLGTNSIGLALVDQEEHQILYSGVRIFPEGINKDTIGLGEKE

ESRNATRRAKRQMRRQYFRKKLRKAKLLELLIAYDMCPLKPEDVRRWKN

WDKQQKSTVRQFPDTPAFREWLKQNPYELRKQAVTEDVTRPELGRILYQ

MIQRRGFLSSRKGKEEGKIFTGKDRMVGIDETRKNLQKQTLGAYLYDIA

PKNGEKYRFRTERVRARYTLRDMYIREFEIIWQRQAGHLGLAHEQATRK

KNIFLEGSATNVRNSKLITHLQAKYGRGHVLIEDTRITVTFQLPLKEVL

GGKIEIEEEQLKFKSNESVLFWQRPLRSQKSLLSKCVFEGRNFYDPVHQ
```

-continued

```
KWIIAGPTPAPLSHPEFEEFRAYQFINNIIYGKNEHLTAIQREAVFELM

CTESKDFNFEKIPKHLKLFEKFNFDDTTKVPACTTISQLRKLFPHPVVV

EEKREEIWHCFYFYDDNTLLFEKLQKDYALQTNDLEKIKKIRLSESYGN

VSLKAIRRINPYLKKGYAYSTAVLLGGIRNSFGKRFEYFKEYEPEIEKA

VCRILKEKNAEGEVIRKIKDYLVHNRFGFAKNDRAFQKLYHHSQAITTQ

AQKERLPETGNLRNPIVQQGLNELRRTVNKLLATCREKYGPSFKFDHIH

VEMGRELRSSKTEREKQSRQIRENEKKNEAAKVKLAEYGLKAYRDNIQK

YLLYKEIEEKGGTVCCPYTGKTLNISHTLGSDNSVQIEHIIPYSISLDD

SLANKTLCDATFNREKGELTPYDFYQKDPSPEKWGASSWEEIEDRAFRL

LPYAKAQRFIRRKPQESNEFISRQLNDTRYISKKAVEYLSAICSDVKAF

PGQLTAELRHLWGLNNILQSAPDITFPLPVSATENHREYYVITNEQNEV

IRLFPKQGETPRIEKGELLLTGEVERKVFRCKGMQEFQTDVSDGKYWRR

IKLSSSVTWSPLFAPKPISADGQIVLKGRIEKGVFVCNQLKQKLKTGLP

DGSYWISLPVISQTFKEGESVNNSKLTSQQVQLFGRVREGIFRCHNYQC

PASGADGNFWCTLDTDTAQPAFTPIKNAPPGVGGGQIILTGDVDDKGIF

HADDDLHYELPASLPKGKYYGIFTVESCDPTLIPIELSAPKTSKGENLI

EGNIWVDEHTGEVRFDPKKNREDQRHHAIDAIVIALSSQSLFQRLSTYN
```

-continued
```
ARRENKKRGLDSTEHFPSPWPGFAQDVRQSVVPLLVSYKQNPKTLCKIS

KTLYKDGKKIHSCGNAVRGQLHKETVYGQRTAPGATEKSYHIRKDIREL

KTSKHIGKVVDITIRQMLLKHLQENYHIDITQEFNIPSNAFFKEGVYRI
FLPNKHGEPVPIKKIRMKEELGNAERLKDNINQYVNPRNNHHVMIYQDA
DGNLKEEIVSFWSVIERQNQGQPIYQLPREGRNIVSILQINDTFLIGLK
EEEPEVYRNDLSTLSKHLYRVQKLSGMYYTFRHHLASTLNNEREEFRIQ
SLEAWKRANPVKVQIDEIGRITFLNGPLC.
```

In some embodiments of the compositions of the disclosure, the sequence encoding the first RNA binding protein comprises a sequence isolated or derived from a CRISPR Cas protein or portion thereof. In some embodiments, the CRISPR Cas protein comprises a Type V CRISPR Cas protein. In some embodiments, the Type V CRISPR Cas protein comprises a Cpf1 protein. Exemplary Cpf1 proteins of the disclosure may be isolated or derived from any species, including, but not limited to, a bacteria or an archaea. Exemplary Cpf1 proteins of the disclosure may be isolated or derived from any species, including, but not limited to, *Francisella tularensis* subsp. *novicida, Acidaminococcus* sp. BV3L6 and *Lachnospiraceae bacterium* sp. ND2006. Exemplary Cpf1 proteins of the disclosure may be nuclease inactivated.

Exemplary wild type *Francisella tularensis* subsp. *Novicida* Cpf1 (FnCpf1) proteins of the disclosure may comprise or consist of the amino acid sequence:

```
                                                    (SEQ ID NO: 172)
   1 MSIYQEFVNK YSLSKTLRFE LIPQGKTLEN IKARGLILDD EKRAKDYKKA KQIIDKYHQF
  61 FIEEILSSVC ISEDLLQNYS DVYFKLKKSD DDNLQKDFKS AKDTIKKQIS EYIKDSEKFK
 121 NLFNQNLIDA KKGQESDLIL WLKQSKDNGI ELFKANSDIT DIDEALEIIK SFKGWTTYFK
 181 GFHENRKNVY SSNDIPTSII YRIVDDNLPK FLENKAKYES LKDKAPEAIN YEQIKKDLAE
 241 ELTFDIDYKT SEVNQRVFSL DEVFEIANFN NYLNQSGITK FNTIIGGKFV NGENTKRKGI
 301 NEYINLYSQQ INDKTLKKYK MSVLFKQILS DTESKSFVID KLEDDSDVVT TMQSFYEQIA
 361 AFKTVEEKSI KETLSLLFDD LKAQKLDLSK IYFKNDKSLT DLSQQVFDDY SVIGTAVLEY
 421 ITQQIAPKNL DNPSKKEQEL IAKKTEKAKY LSLETIKLAL EEFNKHRDID KQCRFEEILA
 481 NFAAIPMIFD EIAQNKDNLA QISIKYQNQG KKDLLQASAE DDVKAIKDLL DQTNNLLHKL
 541 KIFHISQSED KANILDKDEH FYLVFEECYF ELANIVPLYN KIRNYITQKP YSDEKFKLNF
 601 ENSTLANGWD KNKEPDNTAI LFIKDDKYYL GVMNKKNNKI FDDKAIKENK GEGYKKIVYK
 661 LLPGANKMLP KVFFSAKSIK FYNPSEDILR IRNHSTHTKN GSPQKGYEKF EFNIEDCRKF
 721 IDFYKQSISK HPEWKDFGFR FSDTQRYNSI DEFYREVENQ GYKLTFENIS ESYIDSVVNQ
 781 GKLYLFQIYN KDFSAYSKGR PNLHTLYWKA LFDERNLQDV VYKLNGEAEL FYRKQSIPKK
 841 ITHPAKEAIA NKNKDNPKKE SVFEYDLIKD KRFTEDKFFF HCPITINFKS SGANKFNDEI
 901 NLLLKEKAND VHILSIDRGE RHLAYYTLVD GKGNIIKQDT FNIIGNDRMK TNYHDKLAAI
 961 EKDRDSARKD WKKINNIKEM KEGYLSQVVH EIAKLVIEYN AIVVFEDLNF GFKRGRFKVE
1021 KQVYQKLEKM LIEKLNYLVF KDNEFDKTGG VLRAYQLTAP FETFKKMGKQ TGIIYYVPAG
1081 FTSKICPVTG FVNQLYPKYE SVSKSQEFFS KFDKICYNLD KGYFEFSFDY KNFGDKAAKG
1141 KWTIASFGSR LINFRNSDKN HNWDTREVYP TKELEKLLKD YSIEYGHGEC IKAAICGESD
```

```
1201 KKFFAKLTSV LNTILQMRNS KTGTELDYLI SPVADVNGNF FDSRQAPKNM PQDADANGAY

1261 HIGLKGLMLL GRIKNNQEGK KLNLVIKNEE YFEFVQNRNN.
```

Exemplary wild type *Lachnospiraceae bacterium* sp. ND2006 Cpf1 (LbCpf1) proteins of the disclosure may comprise or consist of the amino acid sequence:

```
                                                         (SEQ ID NO: 173)
   1 AASKLEKFTN CYSLSKTLRF KAIPVGKTQE NIDNKRLLVE DEKRAEDYKG VKKLLDRYYL

61 SFINDVLHSI KLKNLNNYIS LFRKKTRTEK ENKELENLEI NLRKEIAKAF KGAAGYKSLF

121 KKDIIETILP EAADDKDEIA LVNSENGFTT AFTGFFDNRE NMFSEEAKST SIAFRCINEN

181 LTRYISNMDI FEKVDAIFDK HEVQEIKEKI LNSDYDVEDF FEGEFFNFVL TQEGIDVYNA

241 IIGGFVTESG EKIKGLNEYI NLYNAKTKQA LPKFKPLYKQ VLSDRESLSF YGEGYTSDEE

301 VLEVFRNTLN KNSEIFSSIK KLEKLFKNFD EYSSAGIFVK NGPAISTISK DIFGEWNLIR

361 DKWNAEYDDI HLKKKAVVTE KYEDDRRKSF KKIGSFSLEQ LQEYADADLS VVEKLKEIII

421 QKVDEIYKVY GSSEKLFDAD FVLEKSLKKN DAVVAIMKDL LDSVKSFENY IKAFFGEGKE

481 TNRDESFYGD FVLAYDILLK VDHIYDAIRN YVTQKPYSKD KFKLYFQNPQ FMGGWDKDKE

541 TDYRATILRY GSKYYLAIMD KKYAKCLQKI DKDDVNGNYE KINYKLLPGP NKMLPKVFFS

601 KKWMAYYNPS EDIQKIYKNG TFKKGDMFNL NDCHKLIDFF KDSISRYPKW SNAYDFNFSE

661 TEKYKDIAGF YREVEEQGYK VSFESASKKE VDKLVEEGKL YMFQIYNKDF SDKSHGTPNL

721 HTMYFKLLFD ENNHGQIRLS GGAELFMRRA SLKKEELVVH PANSPIANKN PDNPKKTTTL

781 SYDVYKDKRF SEDQYELHIP IAINKCPKNI FKINTEVRVL LKHDDNPYVI GIDRGERNLL

841 YIVVVDGKGN IVEQYSLNEI INNFNGIRIK TDYHSLLDKK EKERFEARQN WTSIENIKEL

901 KAGYISQVVH KICELVEKYD AVIALEDLNS GFKNSRVKVE KQVYQKFEKM LIDKLNYMVD

961 KKSNPCATGG ALKGYQITNK FESFKSMSTQ NGFIFYIPAW LTSKIDPSTG FVNLLKTKYT

1021 SIADSKKFIS SFDRIMYVPE EDLFEFALDY KNFSRTDADY IKKWKLYSYG NRIRIFAAAK

1081 KNNVFAWEEV CLTSAYKELF NKYGINYQQG DIRALLCEQS DKAFYSSFMA LMSLMLQMRN

1141 SITGRTDVDF LISPVKNSDG IFYDSRNYEA QENAILPKNA DANGAYNIAR KVLWAIGQFK

1201 KAEDEKLDKV KIAISNKEWL EYAQTSVK.
                                                                      45
```

Exemplary wild type *Acidaminococcus* sp. BV3L6 Cpf1 (AsCpf1) proteins of the disclosure may comprise or consist of the amino acid sequence:

```
                                                         (SEQ ID NO: 174)
   1 MTQFEGFTNL YQVSKTLRFE LIPQGKTLKH IQEQGFIEED KARNDHYKEL KPIIDRIYKT

61 YADQCLQLVQ LDWENLSAAI DSYRKEKTEE TRNALIEEQA TYRNAIHDYF IGRIDNLIDA

121 INKRHAEIYK GLFKAELFNG KVLKQLGTVT TTEHENALLR SFDKFTTYFS GFYENRKNVF

181 SAEDISTAIP HRIVQDNFPK FKENCHIFTR LITAVPSLRE HFENVKKAIG IFVSTSIEEV

241 FSFPFYNQLL TQTQIDLYNQ LLGGISREAG TEKIKGLNEV LNLAIQKNDE TAHIIASLPH

301 RFIPLFKQIL SDRNTLSFIL EEFKSDEEVI QSFCKYKTLL RNENVLETAE ALFNELNSID

361 LTHIFISHKK LETISSALCD HWDTLRNALY ERRISELTGK ITKSAKEKVQ RSLKHEDINL

421 QEIISAAGKE LSEAFKQKTS EILSHAHAAL DQPLPTTLKK QEEKEILKSQ LDSLLGLYHL

481 LDWFAVDESN EVDPEFSARL TGIKLEMEPS LSFYNKARNY ATKKPYSVEK FKLNFQMPTL

541 ASGWDVNKEK NNGAILFVKN GLYYLGIMPK QKGRYKALSF EPTEKTSEGF DKMYYDYFPD
```

-continued

```
 601 AAKMIPKCST QLKAVTAHFQ THTTPILLSN NFIEPLEITK EIYDLNNPEK EPKKFQTAYA

661 KKTGDQKGYR EALCKWIDFT RDFLSKYTKT TSIDLSSLRP SSQYKDLGEY YAELNPLLYH

721 ISFQRIAEKE IMDAVETGKL YLFQIYNKDF AKGHHGKPNL HTLYWTGLFS PENLAKTSIK

781 LNGQAELFYR PKSRMKRMAH RLGEKMLNKK LKDQKTPIPD TLYQELYDYV NHRLSHDLSD

841 EARALLPNVI TKEVSHEIIK DRRFTSDKFF FHVPITLNYQ AANSPSKFNQ RVNAYLKEHP

901 ETPIIGIDRG ERNLIYITVI DSTGKILEQR SLNTIQQFDY QKKLDNREKE RVAARQAWSV

961 VGTIKDLKQG YLSQVIHEIV DLMIHYQAVV VLENLNFGFK SKRTGIAEKA VYQQFEKMLI

1021 DKLNCLVLKD YPAEKVGGVL NPYQLTDQFT SFAKMGTQSG FLFYVPAPYT SKIDPLTGFV

1081 DPFVWKTIKN HESRKHFLEG FDFLHYDVKT GDFILHFKMN RNLSFQRGLP GFMPAWDIVF

1141 EKNETQFDAK GTPFIAGKRI VPVIENHRFT GRYRDLYPAN ELIALLEEKG IVFRDGSNIL

1201 PKLLENDDSH AIDTMVALIR SVLQMRNSNA ATGEDYINSP VRDLNGVCFD SRFQNPEWPM

1261 DADANGAYHI ALKGQLLLNH LKESKDLKLQ NGISNQDWLA YIQELRN.
```

In some embodiments of the compositions of the disclosure, the sequence encoding the first RNA binding protein comprises a sequence isolated or derived from a CRISPR Cas protein. In some embodiments, the CRISPR Cas protein comprises a Type VI CRISPR Cas protein or portion thereof. In some embodiments, the Type VI CRISPR Cas protein comprises a Cas13 protein or portion thereof. Exemplary Cas13 proteins of the disclosure may be isolated or derived from any species, including, but not limited to, a bacteria or an archaea. Exemplary Cas13 proteins of the disclosure may be isolated or derived from any species, including, but not limited to, *Leptotrichia wadei*, *Listeria seeligeri* serovar 1/2b (strain ATCC 35967/DSM 20751/CIP 100100/SLCC 3954), *Lachnospiraceae bacterium*, *Clostridium aminophilum* DSM 10710, *Carnobacterium gallinarum* DSM 4847, *Paludibacter propionicigenes* WB4, *Listeria weihenstephanensis* FSL R9-0317, *Listeria weihenstephanensis* FSL R9-0317, bacterium FSL M6-0635 (*Listeria newyorkensis*), *Leptotrichia wadei* F0279, *Rhodobacter capsulatus* SB 1003, *Rhodobacter capsulatus* R121, *Rhodobacter capsulatus* DE442 and *Corynebacterium ulcerans*. Exemplary Cas13 proteins of the disclosure may be DNA nuclease inactivated. Exemplary Cas13 proteins of the disclosure include, but are not limited to, Cas13a, Cas13b, Cas13c, Cas13d and orthologs thereof. Exemplary Cas13b proteins of the disclosure include, but are not limited to, subtypes 1 and 2 referred to herein as Csx27 and Csx28, respectively.

Exemplary Cas13a proteins include, but are not limited to:

| Cas13a number | Cas13a abbreviation | Organism name | Accession number | Direct Repeat sequence |
|---|---|---|---|---|
| Cas13a1 | LshCas13a | *Leptotrichia shahii* | WP_018451595.1 | CCACCCCAATATCGAAGGGGACTAAAAC (SEQ ID NO: 175) |
| Cas13a2 | LwaCas13a | *Leptotrichia wadei* | WP_021746774.1 | GATTTAGACTACCCCAAAAACGAAGGGGACTAAAAC (SEQ ID NO: 176) |
| Cas13a3 | LseCas13a | *Listeria seeligeri* | WP_012985477.1 | GTAAGAGACTACCTCTATATGAAAGAGGACTAAAAC (SEQ ID NO: 177) |
| Cas13a4 | LbmCas13a | *Lachnospiraceae bacterium* MA2020 | WP_044921188.1 | GTATTGAGAAAAGCCAGATATAGTTGGCAATAGAC (SEQ ID NO: 178) |
| Cas13a5 | LbnCas13a | *Lachnospiraceae bacterium* NK4A179 | WP_022785443.1 | GTTGATGAGAAGAGCCCAAGATAGAGGGCAATAAC (SEQ ID NO: 179) |
| Cas13a6 | CamCas13a | [*Clostridium*] *aminophilum* DSM 10710 | WP_031473346.1 | GTCTATTGCCCTCTATATCGGGCTGTTCTCCAAAC (SEQ ID NO: 180) |
| Cas13a7 | CgaCas13a | *Carnobacterium gallinarum* DSM 4847 | WP_034560163.1 | ATTAAAGACTACCTCTAAATGTAAGAGGACTATAAC (SEQ ID NO: 181) |
| Cas13a8 | Cga2Cas13a | *Carnobacterium gallinarum* DSM 4847 | WP_034563842.1 | AATATAAACTACCTCTAAATGTAAGAGGACTATAAC (SEQ ID NO: 182) |

| Cas13a number | Cas13a abbreviation | Organism name | Accession number | Direct Repeat sequence |
|---|---|---|---|---|
| Cas13a9 | PprCas13a | *Paludibacter propionicigenes* WB4 | WP_013443710.1 | CTTGTGGATTATCCCAAAATTGAAG GGAACTACAAC (SEQ ID NO: 183) |
| Cas13a10 | LweCas13a | *Listeria weihenstephanensis* FSL R9-0317 | WP_036059185.1 | GATTTAGAGTACCTCAAAATAGAAG AGGTCTAAAAC (SEQ ID NO: 184) |
| Cas13a11 | LbfCas13a | *Listeriaceae bacterium* FSL M6-0635 (*Listeria newyorkensis*) | WP_036091002.1 | GATTTAGAGTACCTCAAAACAAAAG AGGACTAAAAC (SEQ ID NO: 185) |
| Cas13a12 | Lwa2cas13a | *Leptotrichia wadei* F0279 | WP_021746774.1 | GATATAGATAACCCCAAAAACGAA GGGATCTAAAAC (SEQ ID NO: 186) |
| Cas13a13 | RcsCas13a | *Rhodobacter capsulatus* SB 1003 | WP_013067728.1 | GCCTCACATCACCGCCAAGACGACG GCGGACTGAAC (SEQ ID NO: 187) |
| Cas13a14 | RcrCas13a | *Rhodobacter capsulatus* R121 | WP_023911507.1 | GCCTCACATCACCGCCAAGACGACG GCGGACTGAAC (SEQ ID NO: 188) |
| Cas13a15 | RcdCas13a | *Rhodobacter capsulatus* DE442 | WP_023911507.1 | GCCTCACATCACCGCCAAGACGACG GCGGACTGAAC (SEQ ID NO: 189) |

Exemplary wild type Cas13a proteins of the disclosure may comprise or consist of the amino acid sequence:

```
                                                      (SEQ ID NO: 190)
   1 MGNLFGHKRW YEVRDKKDFK IKRKVKVKRN YDGNKYILNI NENNNKEKID NNKFIRKYIN

61 YKKNDNILKE FTRKFHAGNI LFKLKGKEGI IRIENNDDFL ETEEVVLYIE AYGKSEKLKA

121 LGITKKKIID EAIRQGITKD DKKIEIKRQE NEEEIEIDIR DEYTNKTLND CSIILRIIEN

181 DELETKKSIY EIFKNINMSL YKIIEKIIEN ETEKVFENRY YEEHLREKLL KDDKIDVILT

241 NFMEIREKIK SNLEILGFVK FYLNVGGDKK KSKNKKMLVE KILNINVDLT VEDIADFVIK

301 ELEFWNITKR IEKVKKVNNE FLEKRRNRTY IKSYVLLDKH EKFKIERENK KDKIVKFFVE

361 NIKNNSIKEK IEKILAEFKI DELIKKLEKE LKKGNCDTEI FGIFKKHYKV NFDSKKFSKK

421 SDEEKELYKI IYRYLKGRIE KILVNEQKVR LKKMEKIEIE KILNESILSE KILKRVKQYT

481 LEHIMYLGKL RHNDIDMITV NTDDFSRLHA KEELDLELIT FFASTNMELN KIFSRENINN

541 DENIDFFGGD REKNYVLDKK ILNSKIKIIR DLDFIDNKNN ITNNFIRKFT KIGTNERNRI

601 LHAISKERDL QGTQDDYNKV INIIQNLKIS DEEVSKALNL DVVFKDKKNI ITKINDIKIS

661 EENNNDIKYL PSFSKVLPEI LNLYRNNPKN EPFDTIETEK IVLNALIYVN KELYKKLILE

721 DDLEENESKN IFLQELKKTL GNIDEIDENI IENYYKNAQI SASKGNNKAI KKYQKKVIEC

781 YIGYLRKNYE ELFDFSDFKM NIQEIKKQIK DINDNKTYER ITVKISDKTI VINDDFEYII

841 SIFALLNSNA VINKIRNRFF ATSVWLNTSE YQNIIDILDE IMQLNTLRNE CITENWNLNL

901 EEFIQKMKEI EKDFDDFKIQ TKKEIFNNYY EDIKNNILTE FKDDINGCDV LEKKLEKIVI

961 FDDETKFEID KKSNILQDEQ RKLSNINKKD LKKKVDQYIK DKDQEIKSKI LCRIIFNSDF

1021 LKKYKKEIDN LIEDMESENE NKFQEIYYPK ERKNELYIYK KNLFLNIGNP NFDKIYGLIS

1081 NDIKMADAKF LFNIDGKNIR KNKISEIDAI LKNLNDKLNG YSKEYKEKYI KKLKENDDFF
```

```
-continued
1141 AKNIQNKNYK SFEKDYNRVS EYKKIRDLVE FNYLNKIESY LIDINWKLAI QMARFERDMH

1201 YIVNGLRELG IIKLSGYNTG ISRAYPKRNG SDGFYTTTAY YKFFDEESYK KFEKICYGFG

1261 IDLSENSEIN KPENESIRNY ISHFYIVRNP FADYSIAEQI DRVSNLLSYS TRYNNSTYAS

1321 VFEVFKKDVN LDYDELKKKF KLIGNNDILE RLMKPKKVSV LELESYNSDY IKNLIIELLT

1381 KIENTNDTL.
```

Exemplary Cas13b proteins include, but are not limited to:

| Species | Cas13b Accession | Cas13b Size (aa) |
|---|---|---|
| *Paludibacter propionicigenes* WB4 | WP_013446107.1 | 1155 |
| *Prevotella* sp. P5-60 | WP_044074780.1 | 1091 |
| *Prevotella* sp. P4-76 | WP_044072147.1 | 1091 |
| *Prevotella* sp. P5-125 | WP_044065294.1 | 1091 |
| *Prevotella* sp. P5-119 | WP_042518169.1 | 1091 |
| *Capnocytophaga canimorsus* Cc5 | WP_013997271.1 | 1200 |
| *Phaeodactylibacter xiamenensis* | WP_044218239.1 | 1132 |
| *Porphyromonas gingivalis* W83 | WP_005873511.1 | 1136 |
| *Porphyromonas gingivalis* F0570 | WP_021665475.1 | 1136 |
| *Porphyromonas gingivalis* ATCC 33277 | WP_012458151.1 | 1136 |
| *Porphyromonas gingivalis* F0185 | ERJ81987.1 | 1136 |
| *Porphyromonas gingivalis* F0185 | WP_021677657.1 | 1136 |
| *Porphyromonas gingivalis* SJD2 | WP_023846767.1 | 1136 |
| *Porphyromonas gingivalis* F0568 | ERJ65637.1 | 1136 |
| *Porphyromonas gingivalis* W4087 | ERJ87335.1 | 1136 |
| *Porphyromonas gingivalis* W4087 | WP_021680012.1 | 1136 |
| *Porphyromonas gingivalis* F0568 | WP_021663197.1 | 1136 |
| *Porphyromonas gingivalis* | WP_061156637.1 | 1136 |
| *Porphyromonas gulae* | WP_039445055.1 | 1136 |
| *Bacteroides pyogenes* F0041 | ERI81700.1 | 1116 |
| *Bacteroides pyogenes* JCM 10003 | WP_034542281.1 | 1116 |
| *Alistipes* sp. ZOR0009 | WP_047447901.1 | 954 |
| *Flavobacterium branchiophilum* FL-15 | WP_014084666.1 | 1151 |
| *Prevotella* sp. MA2016 | WP_036929175.1 | 1323 |
| *Myroides odoratimimus* CCUG 10230 | EHO06562.1 | 1160 |
| *Myroides odoratimimus* CCUG 3837 | EKB06014.1 | 1158 |
| *Myroides odoratimimus* CCUG 3837 | WP_006265509.1 | 1158 |
| *Myroides odoratimimus* CCUG 12901 | WP_006261414.1 | 1158 |
| *Myroides odoratimimus* CCUG 12901 | EHO08761.1 | 1158 |
| *Myroides odoratimimus* (NZ_CP013690.1) | WP_058700060.1 | 1160 |
| *Bergeyella zoohelcum* ATCC 43767 | EKB54193.1 | 1225 |
| *Capnocytophaga cynodegmi* | WP_041989581.1 | 1219 |
| *Bergeyella zoohelcum* ATCC 43767 | WP_002664492.1 | 1225 |
| *Flavobacterium* sp. 316 | WP_045968377.1 | 1156 |
| *Psychroflexus torquis* ATCC 700755 | WP_015024765.1 | 1146 |
| *Flavobacterium columnare* ATCC 49512 | WP_014165541.1 | 1180 |
| *Flavobacterium columnare* | WP_060381855.1 | 1214 |
| *Flavobacterium columnare* | WP_063744070.1 | 1214 |
| *Flavobacterium columnare* | WP_065213424.1 | 1215 |
| *Chryseobacterium* sp. YR477 | WP_047431796.1 | 1146 |
| *Riemerella anatipestifer* ATCC 11845 = DSM 15868 | WP_004919755.1 | 1096 |
| *Riemerella anatipestifer* RA-CH-2 | WP_015345620.1 | 949 |
| *Riemerella anatipestifer* | WP_049354263.1 | 949 |
| *Riemerella anatipestifer* | WP_061710138.1 | 951 |
| *Riemerella anatipestifer* | WP_064970887.1 | 1096 |
| *Prevotella saccharolytica* F0055 | EKY00089.1 | 1151 |
| *Prevotella saccharolytica* JCM 17484 | WP_051522484.1 | 1152 |
| *Prevotella buccae* ATCC 33574 | EFU31981.1 | 1128 |
| *Prevotella buccae* ATCC 33574 | WP_004343973.1 | 1128 |
| *Prevotella buccae* D17 | WP_004343581.1 | 1128 |
| *Prevotella* sp. MSX73 | WP_007412163.1 | 1128 |
| *Prevotella pallens* ATCC 700821 | EGQ18444.1 | 1126 |
| *Prevotella pallens* ATCC 700821 | WP_006044833.1 | 1126 |
| *Prevotella intermedia* ATCC 25611 = DSM 20706 | WP_036860899.1 | 1127 |
| *Prevotella intermedia* | WP_061868553.1 | 1121 |
| *Prevotella intermedia* 17 | AFJ07523.1 | 1135 |
| *Prevotella intermedia* | WP_050955369.1 | 1133 |
| *Prevotella intermedia* | BAU18623.1 | 1134 |
| *Prevotella intermedia* ZT | KJJ86756.1 | 1126 |
| *Prevotella aurantiaca* JCM 15754 | WP_025000926.1 | 1125 |
| *Prevotella pleuritidis* F0068 | WP_021584635.1 | 1140 |
| *Prevotella pleuritidis* JCM 14110 | WP_036931485.1 | 1117 |
| *Prevotella falsenii* DSM 22864 = JCM 15124 | WP_036884929.1 | 1134 |

| Species | Cas13b Accession | Cas13b Size (aa) |
| --- | --- | --- |
| *Porphyromonas gulae* | WP_039418912.1 | 1176 |
| *Porphyromonas* sp. COT-052 OH4946 | WP_039428968.1 | 1176 |
| *Porphyromonas gulae* | WP_039442171.1 | 1175 |
| *Porphyromonas gulae* | WP_039431778.1 | 1176 |
| *Porphyromonas gulae* | WP_046201018.1 | 1176 |
| *Porphyromonas gulae* | WP_039434803.1 | 1176 |
| *Porphyromonas gulae* | WP_039419792.1 | 1120 |
| *Porphyromonas gulae* | WP_039426176.1 | 1120 |
| *Porphyromonas gulae* | WP_039437199.1 | 1120 |
| *Porphyromonas gingivalis* TDC60 | WP_013816155.1 | 1120 |
| *Porphyromonas gingivalis* ATCC 33277 | WP_012458414.1 | 1120 |
| *Porphyromonas gingivalis* A7A1-28 | WP_058019250.1 | 1176 |
| *Porphyromonas gingivalis* JCVI SC001 | EOA10535.1 | 1176 |
| *Porphyromonas gingivalis* W50 | WP_005874195.1 | 1176 |
| *Porphyromonas gingivalis* | WP_052912312.1 | 1176 |
| *Porphyromonas gingivalis* AJW4 | WP_053444417.1 | 1120 |
| *Porphyromonas gingivalis* | WP_039417390.1 | 1120 |
| *Porphyromonas gingivalis* | WP_061156470.1 | 1120 |

Exemplary wild type *Bergeyella zoohelcum* ATCC 43767 Cas13b (BzCas13b) proteins of the disclosure may comprise or consist of the amino acid sequence:

```
                                                        (SEQ ID NO: 191)
   1 menktslgnn iyynpfkpqd ksyfagyfna amentdsvfr elgkrlkgke ytsenffdai 61 fkenislvey eryvkllsdy fpmarlldkk evpikerken fkknfkgiik avrdlrnfyt 121 hkehgeveit deifgvldem lkstvltvkk kkvktdktke ilkksiekql dilcqkkley 181 lrdtarkiee krrnqrerge kelvapfkys dkrddliaai yndafdvyid kkkdslkess 241 kakyntksdp qqeegdlkip iskngvvfll slfltkqeih afkskiagfk atvideatvs 301 eatvshgkns icfmatheif shlaykklkr kvrtaeinyg eaenaeqlsv yaketlmmqm 361 ldelskvpdv vyqnlsedvg ktfiedwney lkenngdvgt meeeqvihpv irkryedkfn 421 yfairfldef aqfptlrfqv hlgnylhdsr pkenlisdrr ikekitvfgr lselehkkal 481 fikntetned rehyweifpn pnydfpkeni svndkdfpia gsildrekqp vagkigikvk 541 llnqqyvsev dkavkahqlk grkaskpsig niieeivpin esnpkeaivf ggqptaylsm 601 ndihsilyef fdkwekkkek lekkgekelr keigkelekk ivgkiqaqiq qiidkdtnak 661 ilkpyqdgns taidkeklik dlkqegnilq klkdeqtvre keyndfiayq dknreinkvr 721 drnhkqylkd nlkrkypeap arkevlyyre kgkvavwlan dikrfmptdf knewkgeqhs 781 llqkslayye qckeelknll pekvfqhlpf klggyfqqky lyqfytcyld krleyisglv 841 qqaenfksen kvfkkvenec fkflkkqnyt hkeldarvqs ilgypifler gfmdekptii 901 kgktfkgnea lfadwfryyk eyqnfqtfyd tenyplvele kkqadrkrkt kiyqqkkndv 961 ftllmakhif ksvfkqdsid qfsledlyqs reerlgnqer arqtgerntn yiwnktvdlk 1021 lcdgkitven vklknvgdfi kyeydgrvqa flkyeeniew qaflikeske eenypyvver 1081 eiegyekvrr eellkevhli eeyilekvkd keilkkgdnq nfkyyilngl lkqlknedve 1141 sykvfnlnte pedvninqlk geatdleqka fvltyirnkf ahnqlpkkef wdycqekygk 1201 ektyaey faevfkkeke alik.
```

In some embodiments of the compositions of the disclosure, the sequence encoding the first RNA binding protein comprises a sequence isolated or derived from a CasRX/Cas13d protein. CasRX/Cas13d is an effector of the type VI-D CRISPR-Cas systems. In some embodiments, the CasRX/Cas13d protein is an RNA-guided RNA endonuclease enzyme that can cut or bind RNA. In some embodiments, the CasRX/Cas13d protein can include one or more higher eukaryotes and prokaryotes nucleotide-binding (HEPN) domains. In some embodiments, the CasRX/Cas13d protein can include either a wild-type or mutated HEPN domain. In some embodiments, the CasRX/Cas13d protein includes a mutated HEPN domain that cannot cut RNA but can process guide RNA. In some embodiments, the CasRX/Cas13d protein does not require a protospacer flanking sequence. Also see WO Publication No. WO2019/040664 & US2019/0062724, which is incorporated herein by reference in its entirety, for further examples and sequences of CasRX/Cas13d protein, without limitation, specific reference is made to Exemplary CasRX/Cas13d proteins may comprise or consist of the sequence:
CasRX/Cas13d Gut_metagenome_contig6049000251:

```
                                                        (SEQ ID NO: 54)
LYLTSFGKGN AAVIEQKIEP ENGYRVTGMQ ITPSITVNKA TDESVRFRVK RKIAQKDEFI    60

ADNPMHEGRH RIEPSAGSDM LGLKTKLEKY YFGKEFDDNL HIQIIYNILD IEKILAVYST   120

NITA.                                                              124
```

Exemplary CasRX/Cas13d proteins may comprise or consist of the sequence:
CasRX/Cas13d Gut_metagenome_contig546000275:

```
                                                        (SEQ ID NO: 57)
MDSYRPKLYK LIDFCIFKHY HEYTEISEKN VDTLRAAVSE EQKESFYADE AKRLWGIFDK    60

QFLGFCKKIN VWVNGSHEKE ILGYIDKDAY RKKSDVSYFS KFLYAMSFFL DGKEINDLLT   120

TLINKFDNIA SFISTAKELD AEIDRILEKK LDPVTGKPLK GKNSFRNFIA NNVIENKRFI   180

YVIKFCNPKN VLKLVKNTKV TEFVLKRMPE SQIDRYYSSC IDTEKNPSVD KKISDLAEMI   240

KKIAFDDFRN VRQKTRTREE SLEKERFKAV IGLYLTVVYL LIKNLVNVNS RYVMAFHCLE   300

RDAKLYGINI GKNYIELTED LCRENENSRS AYLARNKRLR DCVKQNIDNA KNMKSKEK.   358
```

Exemplary CasRX/Cas13d proteins may comprise or consist of the sequence:
CasRX/Cas13d Gut_metagenome_contig4114000374:

```
                                                        (SEQ ID NO: 61)
DTKINPQTWL YQLENTPDLD NEYRDTLDHF FDERFNEINE HFVTQNATNL CIMKEVFPDE    60

DFKSIADLYY DFIVVKSYKN IGFSIKKLRE KMLELPEAKR VTSTEMDSVR SKLYKLIDFC   120

IFKHYHEKPE TVEMIVSMLR AYTSEDMKE.                                   149
```

Exemplary CasRX/Cas13d proteins may comprise or consist of the sequence:
CasRX/Cas13d Gut_metagenome_contig721000619:

```
                                                        (SEQ ID NO: 67)
KEGSTMAKNE KKKSTAKALG LKSSFVVNND IYMTSFGKGN KAVLEKKITE NTIENKSDTT    60

YFDVINRDPK GFTLEGRRIA DMTAFSNDPK YHVNVVNGKF LEDQLGARSE LEKKVFGRTF   120

DDNVHIQLIH NILDIEKIMA QYVSDIVYLL HNTIKRDMND DIMGYISIRN SFDDFCHPER   180

IPDRKAKDNL QKQHDIFFDE ILKCGRLAYF GNAFFEDGSD NKEIAKLKRY KEIYHIIALM   240

GSLRQSYFHG ENSDKNFQGP TWAYTLESNL TGKYKEFKDT LDKTFDERYE MISKDFGSTN   300

MVNLQILEEL LKMLYGNVSP.                                             320
```

Exemplary CasRX/Cas13d proteins may comprise or consist of the sequence:
CasRX/Cas13d Gut_metagenome_contig2002000411:

```
                                                        (SEQ ID NO: 69)
EKQNKAKYQA IISLYLMVMY QIVKNMIYVN SRYVIAFHCL ERDSNQLLGR FNSRDASMYN    60

KLTQKFITDK YLNDGAQGCS KKVGNYLSHN ITCCSDELRK EYRNQVDHFA VVRMIGKYAA   120
```

```
DIGKFSTWFE LYHYVMQRII FDKRNPLSET ERTYKQLIAK HHTYCKDLVK ALNTPFGYNL  180

ARYKNLSIGE LFDRNNYNAK TKET.                                      204
```

Exemplary CasRX/Cas13d proteins may comprise or consist of the sequence:
CasRX/Cas13d Gut_metagenome_contig13552000311:

```
                                                   (SEQ ID NO: 71)
LIDFLIYDLY YNRKPARIEE IVDKLRESVN DEEKESIYSA ETKYVYEALG KVLVRSLKKY   60

LNGATIRDLK NRYDAKTANR IWDISEHSKS GHVNCFCKLI YMMTLMLDGK EINDLLTTLV  120

NKFDNIASFI DVMDELGLEH SFTDNYKMFA DSKAICLDLQ FINSFARMSK IDDEKSKRQL  180

FRDALVVLDI GDKNEDWIEK YLTSDIFKRD ENGNKIDGEK RDFRNFIANN VIKSARFKYL  240

VKYSSADGMI KLKKNEKLIS FVLEQLPETQ IDRYYESCGL DCAVADRKVR IEKLTGLIRD  300

MRFDNFRGVN YSNDACKKDK QAKAKYQAII SLYLMVLYQI VKNMIYVNSR YVIAFHCLER  360

DLLFFNIELD NSYQYSNCNE LTEKFIKDKY MKEGALGFNM KAGRYLTKNI GNCSNELRKI  420

YRNQVDHFAV VRKIGNYAAD IASVGSWFE.                                  449
```

Exemplary CasRX/Cas13d proteins may comprise or consist of the sequence:
CasRX/Cas13d Gut_metagenome_contig10037000527:

```
                                                   (SEQ ID NO: 72)
YMDQNFANSD AWAIHVYRNK IQHLDAVRHA DMYIGDIREF HSWFELYHYI IQRRIIDQYA   60

YESTPGSSRD GSAIIDEERL NPATRRYFRL ITTYKT.                           96
```

Exemplary CasRX/Cas13d proteins may comprise or consist of the sequence:
CasRX/Cas13d Gut_metagenome_contig238000329:

```
                                                   (SEQ ID NO: 73)
RYDKDRSKIY TMMDFVIYRY YIDNNNDSID FINKLRSSID EKSKEKLYNE EANRLWNKLK   60

EYMLYIKEFN GKLASRTPDR DGNISEFVES LPKIHRLLPR GQKISNFSKL MYLLTMFLDG  120

KEINDLLTTL INKFENIQGF LDIMPEINVN AKFEPEYVFF NKSHEIAGEL KLIKGFAQMG  180

EPAATLKLEM TADAIKILGT EKEDAELIKL AESLFKDENG KLLGNKQHGM RNFIGNNVIK  240

SKRFHYLIRY GDPAHLHKIA TNKNVVRFVL GRIADMQKKQ GQKGKNQIDR YYEVCVGNKD  300

IKKTIEEKID ALTDIIVNMN YDQFEKKKAV IENQNRGKTF EEKNKYKRDN AEREKFKKII  360

SLYLTVIYHI LKNIVNVNSR YILGFHCLER DKQLYIEKYN KDKLDGFVAL TKFCLGDEER  420

YEDLKAKAQA SIQALETANP KLYAKYMNYS DEEKKEEFKK QLNRERVKNA RNAYLKNIKN  480

YIMIRLQLRD QTDSSGYLCG EFRDKVAHLE VARHAHEYI.                       519
```

Exemplary CasRX/Cas13d proteins may comprise or consist of the sequence:
CasRX/Cas13d Gut_metagenome_contig2643000492:

```
                                                   (SEQ ID NO: 84)
NGEIVSLAEK EAFSAKIADK NIGCKIENKQ FRHPKGYDVI ADNPIYKGSP RQDMLGLKET   60

LEKRYFSPSD SIDNVRVQVA HNILDIEKIL AEYITNAVYS FDNIAGFGKD IIGDDFSPVY  120

TYDKFEKSDR YEYFKNLLNN SRLGYYGQAF FECDDSKENK KKKDAIKCYN IIALLSGLRH  180

W.                                                                181
```

Exemplary CasRX/Cas13d proteins may comprise or consist of the sequence:
CasRX/Cas13d Gut_metagenome_contig874000057:

```
                                                        (SEQ ID NO: 85)
MSKNKESYAK GMGLKSALVS GSKVYMTSFE GGNDAKLEKV VENSEIVSLA EKESFSAEIF   60

KKNIGCKIEN KKFKHPKRYD VIADNPLYKG SVRQDMLGLK ETLEKRYFNS ADGTDNVCIQ  120

VIHNILDIEK ILAEYITNAV YSFDNIAGFG EDIIGMGGFK PIYTYKQFKE PDKYNKKFDD  180

ILNNSRLGYY GKAFFEKNDL KHNPNKKKRD KNPYILKYDN ECYYIIALLS GLRHWNIHSH  240

AKDDLVSYRW LYNLDSILNR EYISTLNYLY DDIADELTES FSKNSSANVN YIAETLNIDP  300

SEFAQQYFRF SIMKEQKNMG FNVSKLREIM LDRKELSDIR DNHRVFDSIR SKLYTMMDFV  360

IYRYYIEEAA KTEAENRNLP ENEKKISEKD FFVINLRGSF DENQKEKLYI EEAKRLWEKL  420

KDIMLKIKEF RGEKVKEYKK.                                             440
```

Exemplary CasRX/Cas13d proteins may comprise or consist of the sequence:
CasRX/Cas13d Gut_metagenome_contig4781000489:

```
                                                        (SEQ ID NO: 86)
LDKQLDYEYI RTLNYMFNDI ADELTRTFSK NSAANVNYIA ETLNIDPNKF AEQYFRFSIM   60

KEQKNLGFNL TKLRESMLDR RELSDIRDNH NVFDSIRPKL YTMMDFVIYK HYIDEAKKTE  120

AENKSLPDDR KNLSEKD.                                                137
```

Exemplary CasRX/Cas13d proteins may comprise or consist of the sequence:
CasRX/Cas13d Gut_metagenome_contig12144000352:

```
                                                        (SEQ ID NO: 87)
RMGEPVANTK RVMMIDAVKI LGTDLSDDEL KEMADSFFKD SDGNLLKKGK HGMRNFITNN   60

VIKNKRFHYL IRYGDPAHLH EIAKNEA.                                      87
```

Exemplary CasRX/Cas13d proteins may comprise or consist of the sequence:
CasRX/Cas13d Gut_metagenome_contig5590000448:

```
                                                        (SEQ ID NO: 88)
VHNNEEKDLI KYTWLYNLDK YLDAEYITTL NYMYNDIGDE LTDSFSKNSA ANINYIAETL   60

GIDPKTFAEQ YFRFSIMKEQ KNLGFNLTKL REVMLDRKDM SEIRENHNDF DSIRAKVYTM  120

MDFVIYRYYI EEAAKVNAAN KSLPDNEKSL SEKDIFVISL RGSFNEDQKD RLYYDEAQRL  180

WSKVGKLMLK IKKFRGKDRT KYKNMGTPRI RRLIPEGRDI STFSKLMYAL TMFLDGKEIN  240

DLLTTLINKF DNIQSFLKVM PLIGVNAKFA EEYSFFNNSE KIADELRLIK SFARMGEPVA  300

DARRAMYIDA IRILGTDLSD DELKALADSF SLDENGNKLG KGKHGMRNFI INNVITNKRF  360

HYLIRYGNPV HLHEIAKNEA VVKFVLGRIA DIQKKQGQNG KNQIDRYYET CIGK.        414
```

Exemplary CasRX/Cas13d proteins may comprise or consist of the sequence:
CasRX/Cas13d Gut_metagenome_contig525000349:

```
                                                        (SEQ ID NO: 89)
MSKKENRKSY VKGLGLKSTL VSDSKVYLTT FADGSNAKLE KCVENNKIIC ISNDKEAFAA   60

SIANKNVGYK IKNDEKFRHP KGYDIISNNP LLHNNSVQQD MLGLKNVLEK RYFGKSSGGD  120

NNLCIQIIHN IIDIEKILSE YIPNVVYAFN NIAGFKDEHN NIIDIIGTQT YNSSYTYADF  180
```

```
SKDKSDKKYI EFQKLLKNKR LGYWGKAFFT GQGNNAKVRQ ENQCFHIIAL LISLRNWATH  240

SNELDKHTKR TWLYKLDDTN ILNAEYVKTL NYLYDTIADE LTKSFSKNGA VNVNYLAKKY  300

NIKDDLPGFS EQYFRFSIMK EQKNLGFNIS KLRENMLDFK DMSVI.                345
```

Exemplary CasRX/Cas13d proteins may comprise or consist of the sequence:
CasRX/Cas13d Gut_metagenome_contig7229000302:

```
                                                     (SEQ ID NO: 90)
KKISSLTKFC LGESDEKKLK ALAKKSLEEL KTTNSKLYEN YIKYSDERKA EEAKRQINRE   60

RAKTAMNAHL RNTKWNDIMY GQLKDLADSK SRICSEFRNK AAHLEVARYA HMYINDISEV  120

KSYFRLYHYI MQRRIIDVIE NNPKAKYEGK VKVYFEDVKK NKKYNKNLLK LMCVPFGYCI  180

PRFKNLSIEQ MFDMNETDNS DKKKEK.                                     206
```

Exemplary CasRX/Cas13d proteins may comprise or consist of the sequence:
CasRX/Cas13d Gut_metagenome_contig3227000343:

```
                                                     (SEQ ID NO: 91)
IGDISEVNSY FQLYHYIMQR ILIDKIGSKT TGKAKEYFDS VIVNKKYDDR LLKLLCSPLG   60

YCLTRYKDLS IEALFDMNEA AKYDKLNKER KNKKK.                            95
```

Exemplary CasRX/Cas13d proteins may comprise or consist of the sequence:
CasRX/Cas13d Gut_metagenome_contig7030000469:

```
                                                     (SEQ ID NO: 92)
SIRSKLYTMM DFVIYRYYIE ESAKAAAENK PSESDSFVIR LRGSFNENQK EELYIEEAER   60

LWKKFGEIML KIKEFRGEKV KEYKKEVPRI ERILPHGDKI SAFSKLMYML SMFLD.      115
```

Exemplary CasRX/Cas13d proteins may comprise or consist of the sequence:
CasRX/Cas13d gut_metagenome_P17E0k2120140920, c87000043:

```
                                                     (SEQ ID NO: 93)
MYFSKMIYML TYFLDGKEIN DLLTTLISKF DNIKEFLKIM KSSAVDVECE LTAGYKLFND   60

SQRITNELFI VKNIASMRKP AASAKLTMFR DALTILGIDD KITDDRISEI LKLKEKGKGI  120

HGLRNFITNN VIESSRFVYL IKYANAQKIR EVAKNEKVVM FVLGGIPDTQ IERYYKSCVE  180

FPDMNSSLEA KRSELARMIK NISFDDFKNV KQQAKGRENV AKERAKAVIG LYLT.       234
```

Exemplary CasRX/Cas13d proteins may comprise or consist of the sequence:
CasRX/Cas13d Metagenomic hit (no protein accession): contig emb|OBVH01003037.1, human gut metagenome sequence (also found in WGS contigs emb|OBXZ01000094.1| and emb|OBJF01000033.1|):

```
                                                     (SEQ ID NO: 94)
MAKKKRITAK ERKQNHRELL MKKADSNAEK EKAKKPVVEN KPDTAISKDN TPKPNKEIKK   60

SKAKLAGVKW VIKANDDVAY ISSFGKGNNS VLEKRIMGDV SSNVNKDSHM YVNPKYTKKN  120
```

```
YEIKNGFSSG SSLVTYPNKP DKNSGMDALC LKPYFEKDFF GHIFTDNMHI QAIYNIFDIE 180

KILAKHITNI IYTVNSFDRN YNQSGNDTIG FGLNYRVPYS EYGGGKDSNG EPKNQSKWEK 240

RDNFIKFYNE SKPHLGYYEN IFYDHGEPIS EEKFYNYLNI LNFIRNNTFH YKDDDIELYS 300

ENYSEEFVFI NCLNKFVKNK FKNVNKNFIS NEKNNLYIIL NAYGKDTENV EVVKKYSKEL 360

YKLSVLKTNK NLGVNVKKLR ESAIEYGYCP LPYDKEKEVA KLSSVKHKLY KTYDFVITHY 420

LNSNDKLLLE IVETLRLSKN DDEKENVYKK YAEKLFKADD VINPIKAISK LFARKGNKLF 480

KEKIIIKKEY IEDVSIDKNI YDFTKVIFFM TCFLDGKEIN DLLTNIISKL QVIEDHNNVI 540

KFISNNKDAV YKDYSDKYAI FRNAGKIATE LEAIKSIARM ENKIENAPQE PLLKDALLSL 600

GVSDDTKVLE NTYNKYFDSK EKTDKQSQKV STFLMNNVIN NNRFKYVIKY INPADINGLA 660

KNRYLVKFVL SKIPEEQIDS YYKLFSNEEE PGCEEKIKLL TKKISKLNFQ TLFENNKIPN 720

VEKEKKKAII TLYFTIVYIL VKNLVNINGL YTLALYFVER DGYFYKDICG KKDKKKSYND 780

VDYLLLPEIF SGSKYREETK NLKLPKEKDR DIMKKYLPND KDREKYNKFF TAYRNNIVHL 840

NIIAKLSELT KNIDKDINSY FDIYHYCTQR VMFNYCKEKN DVVLAKMKDL AHIKSDCNEF 900

SSKHTYPFSS AVLRFMNLPF AYNVPRFKNL SYKKFFDKQ.                     939
```

Exemplary CasRX/Cas13d proteins may comprise or consist of the sequence:

CasRX/Cas13d Metagenomic hit (no protein accession): contig tpg|DJXD01000002.1| (uncultivated *Ruminococcus* assembly, UBA7013, from sheep gut metagenome):

```
                                                           (SEQ ID NO: 95)
MKKQKSKKTV SKTSGLKEAL SVQGTVIMTS FGKGNMANLS YKIPSSQKPQ NLNSSAGLKN  60

VEVSGKKIKF QGRHPKIATT DNPLFKPQPG MDLLCLKDKL EMHYFGKTFD DNIHIQLIYQ 120

ILDIEKILAV HVNNIVFTLD NVLHPQKEEL TEDFIGAGGW RINLDYQTLR GQTNKYDRFK 180

NYIKRKELLY FGEAFYHENE RRYEEDIFAI LTLLSALRQF CFHSDLSSDE SDHVNSFWLY 240

QLEDQLSDEF KETLSILWEE VTERIDSEFL KTNTVNLHIL CHVFPKESKE TIVRAYYEFL 300

IKKSFKNMGF SIKKLREIML EQSDLKSFKE DKYNSVRAKL YKLFDFIITY YYDHHAFEKE 360

ALVSSLRSSL TEENKEEIYI KTARTLASAL GADFKKAAAD VNAKNIRDYQ KKANDYRISF 420

EDIKIGNTGI GYFSELIYML TLLLDGKEIN DLLTTLINKF DNIISFIDIL KKLNLEFKFK 480

PEYADFFNMT NCRYTLEELR VINSIARMQK PSADARKIMY RDALRILGMD NRPDEEIDRE 540

LERTMPVGAD GKFIKGKQGF RNFIASNVIE SSRFHYLVRY NNPHKTRTLV KNPNVVKFVL 600

EGIPETQIKR YFDVCKGQEI PPTSDKSAQI DVLARIISSV DYKIFEDVPQ SAKINKDDPS 660

RNFSDALKKQ RYQAIVSLYL TVMYLITKNL VYVNSRYVIA FHCLERDAFL HGVTLPKMNK 720

KIVYSQLTTH LLTDKNYTTY GHLKNQKGHR KWYVLVKNNL QNSDITAVSS FRNIVAHISV 780

VRNSNEYISG IGELHSYFEL YHYLVQSMIA KNNWYDTSHQ PKTAEYLNNL KKHHTYCKDF 840

VKAYCIPFGY VVPRYKNLTI NELFDRNNPN PEPKEEV.                       877
```

An exemplary direct repeat sequence of CasRX/Cas13d Metagenomic hit (no protein accession): contig tpg|D-JXD01000002.1| (uncultivated *Ruminococcus* assembly, UBA7013, from sheep gut metagenome) (SEQ ID NO: 95) comprises or consists of the nucleic acid sequence: CasRX/Cas13d DR:

```
                                               (SEQ ID NO: 96)
    caactacaac cccgtaaaaa tacggggttc tgaaac. 36
```

Exemplary CasRX/Cas13d proteins may comprise or consist of the sequence:
CasRX/Cas13d Metagenomic hit (no protein accession): contig OGZC01000639.1 (human gut metagenome assembly):

```
                                                    (SEQ ID NO: 97)
MKKKNIRATR EALKAQKIKK SQENEALKKQ KLAEEAAQKR REELEKKNLA QWEETSAEGR  60

RSRVKAVGVK SVFVVGDDLY LATFGNGNET VLEKKITPDG KITTFPEEET FTAKLKFAQT 120

EPTVATSIGI SNGRIVLPEI SVDNPLHTTM QKNTIKRSAC EDILQLKDVL ENRYFDRSFN 180

DDLHIRLIYN ILDIEKILAE YTTNAVFAID NVSGCSDDFL SNFSTRNQWD EFQNPEQHRE 240

HFGNKDNVIC SVKKQQDLFF NFFKNNRIGY FGKAFFHAES ERKIVKKTEK EVYHILTLIG 300

SLRQWITHST EGGISRLWLY QLEDALSREY QETMNNCYNS TIYGLQKDFE KTNAPNLNFL 360

AEILGKNASE LAEPYFRFII TKEYKNLGFS IKTLREMLLD QPDLQEIREN HNVYDSIRSK 420

LYKMIDFVLV YAYSNERKSK ADALASNLRS AITEDAKKRI YQNEADQLWT SYQELFKRIR 480

GFKGAQVKEY SSKNMPIPIQ KQIQNILKPA EQVTYFTKLM YLLTMFLDGK EINDLLTTLI 540

NKFDNISSLL KTMEQLELQT TFKEDYTFFQ QSSRLCKEIT QLKSFARMGN PISNLKEVMM 600

VDAIQILGTE KSEQELQSMA CFFFRDKNGK KLNTGEHGMR NFIGNNVISN TRFQYLIRYG 660

NPQKLHTLSQ NETVVRFVLS RIAKNQRVQG MNGKNQIDRY YETCGGTNSW SVSEEEKINF 720

LCKILTNMSY DQFQDVKQSG AEITAEEKRK KERYKAIISL YLTVLYQLIK NLVNINARYI 780

IAFHCLERDA ILYSSKFNTS INLKKRYTAL TEMILGYETD EKARRKDTRT VYEKAEAAKN 840

RHLKNVKWNC KTRENLENAD KNAIVAFRNI VAHLWIIRDA DRFITGMGAM KRYFDCYHYL 900

LQRELGYILE KSNQGSEYTK KSLEKVQQYH SYCKDFLHML CLPFAYCIPR YKNLSIAELF 960

DRHEPEAEPK EEASSVNNSQ FITT.                                      984
```

Exemplary CasRX/Cas13d proteins may comprise or consist of the sequence:
CasRX/Cas13d Metagenomic hit (no protein accession): contig emb|OHBM01000764.1 (human gut metagenome assembly):

```
                                                    (SEQ ID NO: 98)
XXXXXXXXXX XXXXXXXXXX XXXXXXXXXX XXXXXXXXXX XXXXXXXXXX XXXXXXXXXX  60

XXXXXXXXXX XXXXXXXXXX XXXXXXXXXX XXXXXXXXXX XXXXXXXXXX XXXXXXXXXX 120

XXXXXXXXXX XXXXXXXXXX XXXXXXXXXX XXXXXXXXXX XXXXXXXXXX XXXXXXXXXX 180

XXXXXXXXXX XXXXXXXXXX XXXXXXXXXX XXXXXXXXXX XXHPLQKRYR YLTSTNLKSF 240

ETYKNNLVNK KKFDLDRVKK IPQLAYFGSA FYNTPEDTSA KITKTKIKSN EEIYYTFMLL 300

STARNFSAHY LDRNRAKSSD AEDFDGTSVI MYNLDNEELY KKLYNKKVHM ALTGMKKVLD 360

ANFNKKVEHL NNSFIKNSAK DFVILCEVLG IKSRDEKTKF VKDYYDFVVR KNYKHLGFSV 420

KELRELLFAN HDSNKYIKEF DKISNKKFDS VRSRLNRLAD YIIYDYYNKN NAKVSDLVKY 480

LRAAADDEQK KKIYLNESIN LVKSGILERI KKILPKLNGK IIGNMQPDST ITASMLHNTG 540
```

```
KDWHPISENA HYFTKWIYTL TLFMDGKEIN DLVTTLINKF DNIASFIEVL KSQSVCTHFS  600

EERKMFIDSA EICSELSAMN SFARMEAPGA SSKRAMFVEA ARILGDNRSK EELEEYFDTL  660

FDKSASKKEK GFRNFIRNNV VDSNRFKYLT RYTDTSSVKA FSNNKALVKF AIKDIPQEQI  720

LRYYNSCFGA SERYYNDGMS DKLVEAIGKI NLMQFNGVIQ QADRNMLPEE KKKANAQKEK  780

YKSIIRLYLT CVYLFFKNLV YVNSRYYSAF YNLEKDRSLF EINGELKPTG KFDEGHYTGL  840

VKLFIDNGWI NPRASAYLTV NLANSDETAI RTFRNTAEHL EALRNADKYL NDLKQFDSYF  900

EIYHYITQRN IKEKCEMLKE QTVKYNNDLL KYHGYSKDFV KALCVPFGYN LPRFKNLSID  960

ALFDKNDKRE KLKKGFED.                                              978
```

Exemplary CasRX/Cas13d proteins may comprise or consist of the sequence:
CasRX/Cas13d Metagenomic hit (no protein accession): contig emb|OHCP01000044.1 (human gut metagenome assembly):

```
                                                    (SEQ ID NO: 99)
MAKKITAKQK REEKERLNKQ KWAKNDSVII VPETKEEIKT GEIQDNNRKR SRQKSQAKAM    60

GLKAVLSFDN KIAIASFVSS KNAKSSHIER ITDKEGTTIS VNSKMFESSV NKRDINIEKR   120

ITIEEPQQDG TIKKEEKGVK STTCNPYFKV GGKDYIGIKE IAEEHFFGRA FPNENLRVQI   180

AYNIFDVQKI LGTFVNNIIY SFYNLSRDEV QSDNDVIGML YSISDYDRQK ETETFLQAKS   240

LLKQTEAYYA YFDDVFKKNK KPDKNKEGDN SKQYQENLRH NFNILRVLSF LRQICMHAEV   300

HVSDDEGCTR TQNYTDSLEA LFNISKAFGK KMPELKTLID NIYSKGINAI NDEFVKNGKN   360

NLYILSKVYP NEKREVLLRE YYNFVVCKEG SNIGISTRKL KETMIAQNMP SLKEENTYRN   420

KLYTVMNFIL VRELKNCATI REQMIKELRA NMDEEEGRDR IYSKYAKEIY LYVKDKLKLM   480

LNVFKEEAEG IIIPGKEDPV KFSHGKLDKK EIESFCLTTK NTEDITKVIY FLCKFLDGKE   540

INELCCAMMN KLDGISDLIE TAKQCGEDVE EFVQFKCLSK CATMSNQIRI VKNISRMKKE   600

MTIDNDTIFL DALELLGRKI EKYQKDKNGD YVKDEKGKKV YTKDYNNFQD MFFEGKNHRV   660

RNFVSNNVIK SKWFSYVVRY NKPAECQALM RNSKLVKFAL DELPDSQIEK YYISVFGEKS   720

SSSNEEMRRE LLKKLCDFSV RGFLDEIVLL SEDEMKQKDK FSEKEKKKSL IRLYLTIVYL   780

ITKSMVKINT RFSIACATYE RDYILLCQSE KAERAWEKGA TAFALTRKFL NHDKPTFEQY   840

YTREREISAM PQEKRKELRK ENDQLLKKTH YSKHAYCYIV DNVNNLTGAV ANDNGRGLPC   900

LSEKNDNANL FLEMRNKIVH LNVVHDMVKY INEIKNITSY YAFFCYVLQR MIIGNNSNEQ   960

NKFKAKYSKT LQEFGTYSKD LMWVLNLPFA YNLPRYKNLS NEQLFYDEEE RMEKIVGRKN  1020

DSR.                                                              1023
```

Exemplary CasRX/Cas13d proteins may comprise or consist of the sequence:
CasRX/Cas13d Metagenomic hit (no protein accession): contig emb|OGDF01008514.1| (human gut metagenome assembly):

```
                                                    (SEQ ID NO: 100)
MTETKPKRED IAKTPAAKSR SKAAGLKSTF AVNGSVLLTS FGRGNDAVPE KLITEKAVSE    60

INTVKPRFSV EKPATSYSSS FGIKSHISAT ADNPLAGRAP VGEDAIHAKE VLEQRVFGKT   120
```

-continued

```
FSDDNIHIQL IYNILDIRKI LSTYANNVVF TINSMRRLDE YDREQDYLGY LYTGNSYERL    180

LDIADKYAVD GEDWRNTAAG ISNDFEKKQF QTINGFWDLL DMIEPYMCYF SEAFFCETTV    240

KDPDSGRIVP CLEQRSDGDI YNILRILSIV RQTCMHDNAS MRTVMFTLGQ NSVRDRKNGF    300

DELAELLDYL YDEKIDIVNR DFLRNQKNNI ELLSRIYGSS ADSPERDRLV QNFYDFRVLS    360

QDKNLGFSIK KLREKLLDSP ALSVVRSKKY DTMRSKIYSL IDFMIYRKFS ENHVAVDDFV    420

EELRSLLTED EKESAYSRWA ETLINDGFAQ EILVKLLPQT DPAVIGKIKG KKLLNDSIAG    480

IKLKKDASFF TKIINVLCMF QDGKEINELV SSLVNKFANI QSFVDVMRSQ GIDSGFTADY    540

AMFAESGRIS RELHILKGIA RMQHSIAGLG DVKIYGSDDK FHGVSRRVYT DAAYILGFGE    600

RSEDNDGYVD DYVSSKLLGG ADKNLRNFIT NNVIKNRRFL YTVRYMNPKR AKKLVQNDAL    660

VVLALSGIPE EQIDRYYKSC IEKRSFNPDL NEKIAALSEM ITTLKIDDFE DVKQNPEKNA    720

NYEAKKNQRI SKERYKACIG LYLTVLYLIC KNLVKINARY SIAIGCLERD TQLHGVDFKG    780

AAYMTRDVFI AKGWINPKKP TVKSIKEQYA FLTPYIFTTY RNMIAHLAAV TNAYKYIPQM    640

DRFKSWFHLY HTVIQHSLIQ QYEYDRDYGR KGAPVVSERV LQLLEQCREH SNYSRDLLHI    900

LNLPFGYNLP RYLNLSSEKY FDANAI.                                       926
```

Exemplary CasRX/Cas13d proteins may comprise or consist of the sequence:
CasRX/Cas13d Metagenomic hit (no protein accession): contig emb|OGPN01002610.1 (human gut metagenome assembly):

```
                                                      (SEQ ID NO: 101)
MAKKITAKQK REEKERLNKQ KWAKQDTPVV PKSKTEEKPV AASDDKLLKT TQVKKVQTKS     60

KAKAMGLKTV LSFDDKIAIA SFVNDKKTKL PHIERITDKS GTTIHENARM FDSSVDEQNV    120

NIEKRMTIEE KQNDGTFKKD EKDVKATICN PYFKTCGKDY IGIKDVAEKY FFGKTFPNEN    180

LRVQIAYNVF DIQKILGTYV NNIIYSFYNL RRDGKSDVDI IGSLYAFADF DNQLKDKPAF    240

REAKDLLKNT EAYFSYFGDV FKKSKKGKKD ENNEDYEKNL RHNFNVLRVL SFLRQICTHA    300

YVKCTGGAKN NGDSTKVEAE SLDALFNITE YFAKTAPELS KTINEIYKEG IDRINNDFVT    360

NGKNNLYILS KVYPDMQRNE LVKKYYQFVV CKEGNNVGIN TRKLKESIIS QHPWITTPQD    420

NNKANDYESC RHKLYTIMCF ILVAELDAHE SIRDNMVAEL RANMDGDDGR DAIYEKYAKD    480

IYHIVKDKLL AMQKVFDEEL VPVKVEGKND PQQFTHGKLG KKEIESFCLS DKNTSDIAKV    540

VYFLCNFLDG KEINELCCAM MNKFDGIGDL IDTAKQCGEE VKFIEEFACL SNCRKITNDI    600

RVAKSISKMK NKVNIDNDII YLDAIELLGR KIEKYQKDEN GKILLGTDGK RLYTQEYKYF    660

NDMFFNAGNH KVRNFIANNV MQSKWFFYVV RYNKPAECQI IMRNKTLVKF TLDDLPDMQI    720

QRYYSSVFGD NNMPAVDEMR KRLLDKINQF SVRGFLDELD EIVLMSDEES KRNKSSEKEQ    780

KKSLIRLYLT IAYLITKSMV KINTRFSIAC AMYERDYALL CQSEMKGGPW DGGAQALAVT    840

RKFLNHDREV FDRYCAREAE IARLPSEERK PLRKANDKLL KQTHYTNHSY TYIVNNLNSF    900

TDIDYCAKDV GLPAPNDKND NASILGEMRN DIAHLNIVHD MVKYIEELKD ISSYYAFYCY    960

VLQRRLVGKD PNCQNKFKAK YAKELNDYGT TNKNLMWMLN LPFAYNLPRY KNLSSEFLFY   1020

DMEYNKKDDE.                                                        1030
```

Exemplary CasRX/Cas13d proteins may comprise or consist of the sequence:
CasRX/Cas13d Metagenomic hit (no protein accession):
from contig emb|OBLI01020244 and emb|OBLI01038679
(from pig gut metagenome):

```
                                                       (SEQ ID NO: 102)
MAKKITAKQR REERERQNKQ KWAKKQADAT AVFECEADIK PADSKDEDCT NIYIKREKKK   60

TQAKAMGLKT VLGFDNKIAI ASFMSSKDSK SSHIERITDP NGKTIREDVR MFDSNVDECS  120

INLEKRMTVE ERQKDGTIKK DEKDVKSTIC NPYSNECGKD YIGIKSVAEE LFFGRTFPND  180

NLRVQIAYNI FDIQKILGTY INNIIYSFYN LSRDESQSDN DVIGTLYMLK DFDGQKETDT  240

FRQARALLER TEAYYSYFDN VFKKIDKNKK KSDDCKRERN EILRYNFNVL RVLSFLRQIC  300

AHAQVKISNE HDREKGGGLV DSLDALFNIS RFFDAVAPEL NEVINSVYSK GIDDINDNFV  360

KNGKNNFYIL SKIYPEVARE DLLREYYYFV VSKEGNNIGI STKKLKEAII VQDMSYIKSE  420

DYDTYRNKLY TVLCFILVKE LNERTTIREQ MVADLRANMN GDIGREDIYS KYAKIIYAQV  480

KPRFDTMKSA FEEEAKDVIV PDKKKPVKFS HGKLDKNEIE RFCITSANTD SVAKIIYFLC  540

KFLDGKEINE LCCAMMNKLD GINDLIETAE QCGAKVEFVD KFSVLSNCET ISDQIRIVKS  600

ISKMKKEIAI DNDTIFLDAL ELLGRKIDKY KKDATGKYLK DENGKYLYSK EYDDFQYMFF  660

KDSHRVRNFI SNSVIKSKWF SYIVRYNQPS ECRAIMKNKT LVKFALDELP DLQIQRYFVA  720

LYGDEDLPSY GEMRKILLKK LHDFSIKGFL DEIVLLSDLD MESQDKYCEK EQKKSLFRLY  780

LTIAYLITKS MVKINTRFSI ACATYERDYA LLCASNKQER AWSSGATALA LTRRFLNQDK  840

LIFEKHYARE GEISKLPKEE RKAMRKVNDQ LLKRTHFSKH SYCYIVDNVN RLTGGECRTD  900

KRVLPVLNEK NDNAGILLDF RKTIAHLNVV HKMVDYVDEI KGITSYYAFF CYVLQRMLVG  960

NNLNEKNAIK EKYSATVKSF GTYSKDFMWL INLPFAYNLP RYKNLSNEQL FYDEEERNET 1020

EEQIDRL.                                                        1027
```

Exemplary CasRX/Cas13d proteins may comprise or consist of the sequence:
CasRX/Cas13d Metagenomic hit (no protein accession):
contig OIZX01000427.1:

```
                                                       (SEQ ID NO: 103)
MAKKKKTARQ LREEMQQQRK QAIQKQQEQR QEKAAAARET AAPEQPAAAP VPKRQRKSLA   60

KAAGLKSNFI LDPQRRTTVM TAFGQGSTAI LEKQIVDRAI SDLQPVQQFQ VEPASAAKYR  120

LKNSRVRFPN VTADDPLYRR KDGGFVPGMD ALRRKNVLEQ RFFGKSFADN IHIQMIYSIL  180

DIHKILAAAS GHIVHLLNIV NGSKDRDFIG MLAAHVLYNE LNEEAKRSIA DFCKSPRLIY  240

YSAAFYETLD NGKSERRSNE DIFNILALMT CLRNFSSHHS IAIKVKDYSA AGLYNLRRLG  300

PDMKKMLDTF YTEAFIQLNQ SFQDHNTTNL TCLFDILNIS DAQRQKQLAE EFYRYVVFKE  360

QKNLGFSVRK LREEMLLLPD AAVIADKRYD TCRSKLYNLM DFLILRVYRT GRADRCDKLP  420

EALRAALTDE EKAVVYHKEA LSLWNEMRTL ELDGLLPQMT PENLSRLSGQ KRKGELSLDD  480

AMLKECLYEP GPVPEDAAPE EANAEYFCRM IYLATLFMDG KEINTLLTTL ISKFENIAAF  540

LQTMEQLNIE AELGPEYAMF TRSRAVAEQL RVINSFALMK KPQVNAKQQL YRAAVTLLGT  600

EDPDGVTDEM LCIDPVTGKM LPPNQRHHGD TGLRNFIANN VVESRRFQYL IRYSDPAQLH  660

QLASNKKLVR FVLSSIPDTQ INRYYETCGQ TRLAGRAAKV EFLTDMIAAI RFDQFRDVNQ  720

KERGANTQKE RYKAMLGLYQ TVLYLAVKNL VNINARYVMA FHCVERDMFL YDGELTDPKG  780

ESVSAFLAVN GKKGVQPQYL LLTQLFIRRD YLKRSACEQI QHNMENISDR LLREYRNAVA  840
```

-continued

```
HLNVIAHLAD YSADMREITS YYGLYHYLMQ RHLFKRHAWQ IRQPERPTEE EQKLIEQEQK  900

QLAWEKALFD KTLQYHSYNK DLVKALNAPF GYNLARYKNL SIEPLFSKEA APAAEIKATH  960

A.                                                                961
```

Exemplary CasRX/Cas13d proteins may comprise or consist of the sequence:
CasRX/Cas13d Metagenomic hit (no protein accession): contig OCTW011587266.1:

```
                                                      (SEQ ID NO: 104)
MKQNDRENNN KIKKSAAKAV GVKSLARLSD GSTVVSSFGK GAAAELESLI TGGEIRKLSD   60

KAILEITDDT QNKNAYNVKS SRIPNLTART DKLSDKSGMD DLGFKRELEL EVFGQCFDDS  120

IHIQIAHAVF DIQKSLAAVI PNVLYTLNNL DRSYSTDNTS DKKDIIGNTL NYQHSYESFN  180

VEKRGEFTEY YNAAKDRFSY FPDILCVLEK VNGKDRYQPK SEKDAFNVLS SVNMLRNSLF  240

HFAPKSNDGK ARIAVFKNQF DSDFSHITST VNKIYSAKIA GVNENFLNNE GNNLYIILKA  300

TNWDIKKIVP QLYRFSVLKS DKNMGFNMRK LREFAVESKN IDLSRLNDKF LTNNRKKLYK  360

VIDFIIYYHL NKVLKDSFVD DFVAALRASQ SEEEKEKLYA QYSERLFADE GLKSAIKKAV  420

DMISDTKSNI FKMKTPLDKA LIENIKVNSD ASDFCKLIYV FTRFLDGKEI NILLNSLIKK  480

FQDIHSFNTT VKKLSENNLI INADYVDDYS LFEQSGTVAR ELMLIKSISK MDFGLDNINL  540

SFMYDDALRT TLVSDENLPE VKREYFGKTK NLSAYIRNNV LENRRFKYVI KYIHPSDVQK  600

IACNKAIAGF VLNRMPDTQI KRYYDSLINK GATDIQAQAK ALLDCITGIS FDAIKDDKHL  660

HKSKEKSPQR SADRERKKAM LTLYYTIVYI FVKQMLHINS LYTIGFFYLE RDQRFIYSRA  720

KKENKNPSKN SYLNDFRSVT AYFIPSEIMK RIEKNENKGF LEDFEALWNS CGKTSRLRKE  780

DVLLYARYIS PDHALKNYKM ILNSYRNKIA HINVIMSAGK YTGGIKRMDS YFSVFQHLVQ  840

CDILSNPNNK GKCFESESLK PLLLDMKFDG TDEKLYSKRL TRALNIPFGY NVPRYKNLTF  900

EKIYLKSSIN E.                                                     911
```

Exemplary CasRX/Cas13d proteins may comprise or consist of the sequence:
CasRX/Cas13d Metagenomic hit (no protein accession): contig emb|OGNF01009141.1:

```
                                                      (SEQ ID NO: 105)
MADIDKKKSS AKAAGLKSTF VLENNKLLMT SFGNGNKAVI EKIIDEKVDS INEPEVFSVT   60

PCDKKFELQP AKRGLAADSL VDNPLKSKKT AGDDAIHSRK FLERQFFDGN TFNDNIHIQL  120

IYNILDIEKI LSVHVNDIVY SVNNILSRGE GMEYNDYIGT LNLKSFETYK NNLVNKKKFD  180

LDRVKKIPQL AYFGSAFYNT PEDTSAKITK TKIKSNEEIY YTFMLLSTAR NFSAHYLDRN  240

RAKSSDAEDF DGTSVIMYNL DNEELYKKLY NKKVHMALTG MKKVLDANFN KKVEHLNNSF  300

IKNSAKDFVI LCEVLGIKSR DEKTKFVKDY YDFVVRKNYK HLGFSVKELR ELLFANHDSN  360

KYIKEFDKIS NKKFDSVRSR LNRLADYIIY DYYNKNNAKV SDLVKYLRAA ADDEQKKKIY  420

LNESINLVKS GILERIKKIL PKLNGKIIGN MQPDSTITAS MLHNTGKDWH PISENAHYFT  480

KWIYTLTLFM DGKEINDLVT TLINKFDNIA SFIEVLKSQS VCTHFSEERK MFIDSAEICS  540

ELSAMNSFAR MEAPGASSKR AMFVEAARIL GDNRSKEELE EYFDTLFDKS ASKKEKGFRN  600

FIRNNVVDSN RFKYLTRYTD TSSVKAFSNN KALVKFAIKD IPQEQILRYY NSCFGASERY  660

YNDGMSDKLV EAIGKINLMQ FNGVIQQADR NMLPEEKKKA NAQKEKYKSI IRLYLTVCYL  720

FFKNLVYVNS RYYSAFYNLE KDRSLFEING ELKPTGKFDE GHYTGLVKLF IDNGWINPRA  780
```

-continued

```
SAYLTVNLAN SDETAIRTFR NTAEHLEALR NADKYLNDLK QFDSYFEIYH YITQRNIKEK   840

CEMLKEQTVK YNNDLLKYHG YSKDFVKALC VPFGYNLPRF KNLSIDALFD KNDKREKLKK   900

GFED.                                                              904
```

Exemplary CasRX/Cas13d proteins may comprise or consist of the sequence:
CasRX/Cas13d Metagenomic hit (no protein accession): contig emb|OIEN01002196.1:

```
                                                        (SEQ ID NO: 106)
MERQKRKMKS KSKMAGVKSV FVIGDELLMT SFGDGDDAVL EKDIDENGVV NDCRNPAAYD    60

AVYGTDSIRV KKTNNNIRAK VNNPLAKSNI RSEESALFRT RVNEYKREQK DKYETLFFGK   120

TFDDNIHIQL ISKILDIEKT FSVVIGNIVY AINNLSLEQS IDRPIDIFGD KNTQGISLRE   180

DNDYLKTMLP RCEYLFHNIL NSDSDNNSKM NYNKVNKGKE EKDNRNNENI EKLKKALEVI   240

KIIRVDSFHG VDGIKGDQKF PRSKYNLAVN YNEEIQKTIS EPFNRKVEEV QQDFYRNSCV   300

NIDFLKEIMY GSNYTDRGSD SLECSYFNFA ILKQNKNMGF SITSIRECLL DLYELNFESM   360

QNLRPRANSF CDFLIYDYYC KNESERANLV DCLRSAASEE EKKNIYFQTA ERVKEKFRNA   420

FNRISRFDAS YIKNSREKNL SGGSSLPKYS FIEGFTKRSK KINDNDEKNA DLFCNMLYYL   480

AQFLDGKEIN IFLTSIHNIF QNIDSFLKVM KEKGMECKFQ KDFKMFSHAG HVAKKIEIVI   540

SLAKMKKTLD FYNAQALKDA VTILGVSKKH QYLDMNSYLD FYMFDNRSGA TGKNAGKDHN   600

LRNFLVSNVI RSRKFNYLSR YSNLAEVKKL AQNPSLVQFV LSRIEPSLIC RYYESSQGIS   660

SEGITIDEQI KKLTGIIVDM NIDSFENINN GEIGMRYSKA TPQSIERRNQ MRVCVGLYLN   720

VLYQIEKNLM NVNARYVLAF AFAERDALML NFTLEECKKN KKRSSGGFSF IEMTQFFIDK   780

KLFKVATEAI KKNVLKYNGN PESLNHIPGE YICKNMEGYH ENTVRNFRNM VAHLTAVARV   840

PLYISEVTQI DSYYALYHYC MQMNILQGIE QSGKILDNIK LKNALENARV HRTYSKDAVK   900

YLCLPFAYNI SRYKALTIKD LFDWTEYSCK KDE.                              933
```

Exemplary CasRX/Cas13d proteins may comprise or consist of the sequence:
CasRX/Cas13d Metagenomic hit (no protein accession): contig e-k87_11092736:

```
                                                        (SEQ ID NO: 107)
MKRQKTFAKR IGIKSTVAYG QGKYAITTFG KGSKAEIAVR SADPPEETLP TESDATLSIH    60

AKFAKAGRDG REFKCGDVDE TRIHTSRSEY ESLISNPAES PREDYLGLKG TLERKFFGDE   120

YPKDNLRIQI IYSILDIQKI LGLYVEDILH FVDGLQDEPE DLVGLGLGDE KMQKLLSKAL   180

PYMGFFGSTD VFKVTKKREE RAAADEHNAK VFRALGAIRQ KLAHFKWKES LAIFGANANM   240

PIRFFQGATG GRQLWNDVIA PLWKKRIERV RKSFLSNSAK NLWVLYQVFK DDTDEKKKAR   300

ARQYYHFSVL KEGKNLGFNL TKTREYFLDK FFPIFHSSAP DVKRKVDTFR SKFYAILDFI   360

IYEASVSVAN SGQMGKVAPW KGAIDNALVK LREAPDEEAK EKIYNVLAAS IRNDSLFLRL   420

KSACDKFGAE QNRPVFPNEL RNNRDIRNVR SEWLEATQDV DAAAFVQLIA FLCNFLEGKE   480

INELVTALIK KFEGIQALID LLRNLEGVDS IRFENEFALF NDDKGNMAGR IARQLRLLAS   540

VGKMKPDMTD AKRVLYKSAL EILGAPPDEV SDEWLAENIL LDKSNNDYQK AKKTVNPFRN   600

YIAKNVITSR SFYYLVRYAK PTAVRKLMSN PKIVRYVLKR LPEKQVASYY SAIWTQSESN   660

SNEMVKLIEM IDRLTTEIAG FSFAVLKDKK DSIVSASRES RAVNLEVERL KKLTTLYMSI   720
```

-continued

```
AYIAVKSLVK VNARYFIAYS ALERDLYFFN EKYGEEFRLH FIPYELNGKT CQFEYLAILK   780

YYLARDEETL KRKCEICEEI KVGCEKHKKN ANPPYEYDQE WIDKKKALNS ERKACERRLH   840

FSTHWAQYAT KRDENMAKHP QKWYDILASH YDELLALQAT GWLATQARND AEHLNPVNEF   900

DVYIEDLRRY PEGTPKNKDY HIGSYFEIYH YIRQRAYLEE VLAKRKEYRD SGSFTDEQLD   960

KLQKILDDIR ARGSYDKNLL KLEYLPFAYN LPRYKNLTTE ALFDDDSVSG KKRVAEWRER  1020

EKTREAEREQ RRQR.                                                  1034
```

An exemplary direct repeat sequence of CasRX/Cas13d Metagenomic hit (no protein accession): contig e-k87_11092736 (SEQ ID NO: 107) comprises or consists of the nucleic acid sequence:
CasRX/Cas13d Direct repeat 1: gtgagaagtc tccttatggg gagatgctac (SEQ ID NO: 108).

Exemplary CasRX/Cas13d proteins may comprise or consist of the sequence:
CasRX/Cas13d Ga0129306_1000735:

```
                                                     (SEQ ID NO: 109)
MQKQREQQTV TDESERKKKP LKSGAKAAGL KSVFVLSEGK ELLTSFGRGN EAVPEKRVTG    60

GITANARTDN KEAFSAALQN KRFEVFGRTA GSSDDPLAVS RAPGQDLIGA KTALEERYFG   120

RAFADNIHMQ VIYAIQDINK ILAVHANNIV TYLNNLDREA DPETDDFIGS GYLTLKNTFE   180

TYCDPAALNE REREKVTVSK QHFDAFMQNP RLAYYGNAFF RKLSKAERLA RGREIFDKES   240

PERRQEILGS RGKNKSVDDE IRALAPEWVK REERDVYSEL VLMSELRQSC FHGQQKNSAR   300

IFRLDNDLGP GVDGARELLD RLYAEKINDL RSFDKTSASS NFRLLFNAYH ADNEKKKELA   360

QEFYRFSVLK VSKNTGFSIR TLREKIIEDH AAQYRDKIYD SMRKKLFSTF DFFLWRFYEE   420

REDEAEELRA CLRAARSDEE KEQIYAEAAA SCWPSVKPFV ESVAATLCDV VKGRTKLNKL   480

KLSADESTLV RNAIDGVRIS PRASYFTKLI YLMTLFLDGK EINDLLTTLI HAFENIDSFL   540

SVLGSERLER TFDANYRIFA DSGVIAQELR AVSNFARMTT EPFNSKLVMF EDAAQLFGMS   600

GGLVEHAEEL REYLDNKMLD KTKLRLLPDG KVDTGFRNFI ISNVTESRRF RYLVRYCEPR   660

AVRDYMSCRP LIRLTLRDMP DTILRRYYEQ SVGAATVDRE RILDTLADKL LSLRFTDFEN   720

VNQRANAERN REKQKMMGII SLYLNVAYQI VKNLVYVNAR YTMAYHCAER DTELLLNAAG   780

EGNLLRRDRS WPARLHLPRR ALARRRDRVE VMERDVARGP EAYNRDEWLG LVRTLRREKR   840

VCDNLHNNYA YLCGADAEPG DASLSLLFVY RNKAAHLSVL NKGGRLSGDL KEAKSWFYVY   900

HFLMQRVLEE EFRNTQALPE RLRELLMMAE RYRGCSKDLI KVLNLTFAYN LPRYKNLSID   960

GRFDKNHPDP SDE.                                                    973
```

Exemplary CasRX/Cas13d proteins may comprise or consist of the sequence:
CasRX/Cas13d Ga0129317_1008067:

```
                                                     (SEQ ID NO: 110)
MKKQKKSLVK AAGLKSAFVV GDSVYLTSFG KGNAARLDTK INPDNSTERY VSDSEKHTLK    60

INSITDTELR LSGPFPKQAE AKNPTHKKDN EQKNTRQDML GLKSTLEKFY FGSTFDDNIH   120

IQIIHNIQDI AKILAAHSNN AGYALDNMLA YQGVEFSDMI GYMGTSRTFD NYDPNHKNNK   180

DFFRFLKLPR LGYFFSAFYS QKGKDFEKRS DEEVYNICAL MGQIRQCCFH GKQEKYQLKW   240

LYNFHNFKSN KPFLDTLDKH FDEMIDRINK NFIKNNTPDL IILSGLYPDM AKKELVRLFY   300

DFTTVKEYKN MGFSVKKLRE KMLESEEASD FRDKDYDSVR RKLYKLMDFC IYYLYYSDSE   360

RNENLVSRLR ESLTDENKDI IYSKEAKIVW NELRKKFSTI LDNVKGSNIK KLENVKEKFI   420
```

-continued

```
SEDEFDDIKL DIDISYFSKL MYVMCYFLDG KEINDLLTTL VSKFDNIGSI IEAATQIGIN  480

IEFIDDFKFF DRSKDISVEL NIIRNFARMQ APVPNAKRAM QEDAIRILGG SEEDIFSILD  540

DMTGYDKSGK KLAQSKKGFR NFIINNVVES SRFKYIVRYS NPQKIRKLAN NSVVVGFVLG  600

KLPDAQIESY FNSCLPNRVY STPDKARESL RDMLHNISFN DFADVKQDDR RATPEEKVEK  660

ERYKAIIGLY LTVMYHLVKN LVYVNSRYVM AFHCLERDAM HYDVSLDNYR DLIRHLISEG  720

DSSCNHFISH NRRMRDCIEE NVKNSEQLIF GKEDAVIRFR NNVAHLSAIR NANEYIGDIR  780

EITSYFALYH YLMQRKLIDD CKVNDTAHKY FEQLTKYKTY VMDMVKALCS PFGYNLPRFK  840

NLSIEGKFDM HESK.                                                   854
```

Exemplary CasRX/Cas13d proteins may comprise or consist of the sequence:
CasRX/Cas13d Ga0224415_10048792:

```
                                                     (SEQ ID NO: 111)
MSKKENRKSY VKGLGLKSTL VSDSKVYLTT FADGSNAKLE KCVENNKIIC ISNDKEAFAA   60

SIANKNVGYK IKNDEKFRHP KGYDIISNNP LLHNNSVQQD MLGLKNVLEK RYFGKSSGGD  120

NNLCIQIIHN IIDIEKILSE YIPNVVYAFN NIAGFKDEHN NIIDIIGTQT YNSSYTYADF  180

SKDKSDKKYI EFQKLLKNKR LGYWGKAFFT GQGNNAKVRQ ENQCFHIIAL LISLRNWATH  240

SNELDKHTKR TWLYKLDDTN ILNAEYVKTL NYLYDTIADE LTKSFSKNGA VNVNYLAKKY  300

NIKDDLPGFS EQYFRFSIMK EQKNLGFNIS LKRENMLDFK DMSVIRDDHN RYDKDRSKIY  360

TMMDFVIYRY YIDNNNDSID FINKLRSSID EKSKEKLYNE EANRLWNKLK EYMLYIKEFN  420

GKLASRTPDR DGNISEFVES LPKIHRLLPR GQKISNFSKL MYLLTMFLDG KEINDLLTTL  480

INKFENIQGF LDIMPEINVN AKFEPEYVFF NKSHEIAGEL KLIKGFAQMG EPAATLKLEM  540

TADAIKILGT EKEDAELIKL EASLFKDENG KLLGNKQHGM RNFIGNNVIK SKRFHYLIRY  600

GDPAHLHKIA TNKNVVRFVL GRIADMQKKQ GQKGKNQIDR YYEVCVGNKD IKKTIEEKID  660

ALTDIIVNMN YDQFEKKKAV IENQNRGKTF EEKNKYKRDN AEREKFKKII SLYLTVIYHI  720

LKNIVNVNSR YILGFHCLER DKQLYIEKYN KDKLDGFVAL TKFCLGDEER FEDLKAKAQA  780

SIQALETANP KLYAKYMNYS DEEKKEEFKK QLNRERVKNA RNAYLKNIKN YIMIRLQLRD  840

QTDSSGYLCG EFRDKVAHLE VARHAHEYIG NIKEVNSYFQ LYHYIMQCRL YDVLKNNTKA  900

EAMVKGKAKE YFEALEKEGT TNDKLLKIAC VPFGYCIPRY KNLSMEELFD MNEEKKFKKK  960

APENT.                                                             965
```

Exemplary CasRX/Cas13d proteins may comprise or consist of the sequence
CasRX/Cas13d 160582958_gene49834:

```
                                                     (SEQ ID NO: 112)
MKNSVTFKLI QAQENKEAAR KKAKDIAEQA RIAKRNGVVK KEENRINRIQ IEIQTQKKSN   60

TQNAYHLKSL AKAAGVKSVF AIGNDLLMTG FGPGNDATIE KRVFQNRAIE TLSSPEQYSA  120

EFQNKQFKIK GNIKVLNHST QKMEEIQTEL ADNYNRPHFD LLGCKNVLEQ KYFGRTFSDN  180

IHVQIAYNIM DIEKLLTPYI NNIIYTLNEL MRDNSKDDFF GCDSHFSVAY LYDELKAGYS  240

DRLKTKPNLS KNIDRIWNNF CNYMNSDSGN TEARLAYFGE LFYKPKETGD AKSDYKTHLS  300

NNQKEEWELK SDKEVYNIFA ILCDLRHFCT HGESITPSGK PFPYNLEKNL FPEAKQVLNS  360

LFEEKAESLG AEAFGKTAGK TDVSILLKVF EKEQASQKEQ QALLKEYYDF KVQKTYKNMG  420

FSIKKLREAI MEIPDAAKFK DDLYSSLRHK LYGLFDFILV KHFLDTSDSE NLQNNDIFRQ  480
```

-continued

```
LRACRCEEEK DQVYRSIAVK VWEKVKKKEL NMFKQVVVIP SLSKDELKQM EMTKNTELLS  540

SIETISTQAS LFSEMIFMMT YLLDGKEINL LCTSLIEKFE NIASFNEVLK SPQIGYETKY  600

TEGYAFFKNA DKTAKELRQV NNMARMTKPL GGVNTKCVMY NEAAKILGAK PMSKAELESV  660

NFLDNHDYTY SPSGKKIPNK NFRNFIINNV ITSRRFLYLI RYGNPEKIRK IAINPSIISF  720

VLKQIPDEQI KRYYPPCIGK RTDDVTLMRD ELGKMLQSVN FEQFSRVNNK QNAKQNPNGE  780

KARLQACVRL YLTVPYLFIK NMVNINARYV LAFHCLERDH ALCFNSRKLN DDSYNEMANK  840

FQMVRKAKKE QYEKEYKCKK QETGTAHTKK IEKLNQQIAY IDKDIKNMHS YTCRNYRNLV  900

AHLNVVSKLQ NYVSELPNDY QITSYFSFYH YCMQLGLMEK VSSKNIPLVE SLKNEANDAQ  960

SYSAKKTLEY FDLIEKNRTY CKDFLKALNA PFSYNLPRFK NLSIEALFDK NIVYEQADLK 1020

KE.                                                              1022
```

An exemplary direct repeat sequence of CasRX/Cas13d proteins may comprise or consist of the sequence CasRX/Cas13d 160582958 _gene49834 (SEQ ID NO: 112) comprises or consists of the nucleic acid sequence: CasRX/Cas13d DR:

```
                                                     (SEQ ID NO: 113)
   gaactacacc cctctgttct tgtaggggtc taacac.  36
```

Exemplary CasRX/Cas13d proteins may comprise or consist of the sequence:
CasRX/Cas13d 250twins_35838_GL0110300:

```
                                                      (SEQ ID NO: 114)
MGNKQRVSAQ KRRENAKLCN QQKARQAESQ RDKIKNMNVE KMKNINTNDI KHTKTTAKKL   60

GLKSTIIADK KIILTSFINE QSSKTANIEK VAGFKGDTID TISYTPRMFR SEINPGEIVI  120

SKGDDLSEFA NPANFPIGRD YVKIRSALEK QYFGKEFPED NLHVQIAYNV ADIKKILSVY  180

INNIIYMFYN LARSEEYDIF YNSQSENSGR DCDVIGSLYY QASYRNQDAN RFEKDGKKKA  240

IDSLLDDTRA YYTYFDGLFS VPKREDDGKI KESEKEKAKD QNFDVLRLLS VGRQLTFHSD  300

KSNNEAYLFD LSKLTRAAQD ENRRQDIQSL LNILNSTCRS NLEGVNGDFV KHAKNNLYVL  360

NQLYPSLKAN DLIGEYYNFI VKKENRNIGI RLITVRELII EHNYTNLKDS KYDTYRNKIY  420

TVLNFILFRE IEQNSIAIKN FREKLRSTEK AEQPALYQAF ANKIYPMVQA KFAKAIDLFE  480

EQYKTKFKSE FKGGISIENM QQQNILLQTE NIDYFSKYVL FLTKFLDGKE INELLCALIN  540

KFDNIADLLD ISKQIGTPVV FCADYESLND AAKIAENIRL IKNIAHLRPA IQEAQSSKDN  600

ADAAGTPATL LIDAYNMLNT DIQLVYGEAA YEELRKDLFE RKNGTKYNKK GKKVDVYDHK  660

FRNFLINNVI KSKWFFYIAK YVKPADCAKM MSNKKMIEFA LRDLPETQIK RYYYTITGNE  720

ALGDAESLKG VIIEQLHAFS IKNTLLSIKN MGEGEYKIQQ IGSSKEKLKA IVNLYLTVAY  780

LLTKSLVKVN IRFSIAFGCL ERDLVLQKKS EKKFDAIINE ILLEDDKIRK ECDKERAQAK  840

TLPRELAQER FAQIKRRESG CYFKSYHVYD YLSKNSNEFK QNHIDFAVTS YRNNVEHLNH  900

VHCMTKYFSE VKDVKSYYGV YCYIMQRMLC DELIIKNQDK PDVRQTFEEY NRLLKDHGTY  960

SKNLMWLLNF PFAYNLARYK NLSNEDLFNA KNNDQKSK.                        998
```

Exemplary CasRX/Cas13d proteins may comprise or consist of the sequence:
CasRX/Cas13d 250twins_36050_GL0158985:

```
                                                          (SEQ ID NO: 115)
MKKKHQSAAE KRQVKKLKNQ EKAQKYASEP SPLQSDTAGV ECSQKKTVVS HIASSKTLAK    60

AMGLKSTLVM GDKLVITSFA ASKAVGGAGY KSANIEKITD LQGRVIEEHE RMFSADVGEK   120

NIELSKNDCH TNVNNPVVTN IGKDYIGLKS RLEQEFFGKT FENDNLHVQL AYNILDIKKI   180

LGTYVNNIIY IFYNLNRAGT GRDERMYDDL IGTLYAYKPM EAQQTYLLKG DKDMRRFEEV   240

KQLLQNTSAY YVYYGTLFEK VKAKSKKEQR AKEAEIDACT AHNYDVLRLL SLMRQLCMHS   300

VAGTAFKLAE SALFNIEDVL SADLKEILDE AFSGAVNKLN DGFVQHSGNN LYVLQQLYPN   360

ETIERIAEKY YRLTVRKEDL NMGVNIKKLR ELIVGQYFPE VLDKEYDLSK NGDSVVTYRS   420

KIYTVMNYIL LYYLEDHDSS RESMVEALRQ NREGDEGKEE IYRQFAKKVW NGVSGLFGVC   480

LNLFKTEKRN KFRSKVALPD VSGAAYMLSS ENIDYFVKML FFVCKFLDGK EINELLCALI   540

NKFDNIADIL DAAAQCGSSV WFVDSYRFFE RSRRISAQIR IVKNIASKDF KKSKKDSDES   600

YPEQLYLDAL ALLGDVISKY KQNRDGSVVI DDQGNAVLTE QYKRFRYEFF EEIKRDESGG   660

IKYKKSGKPE YNHQRRNFIL NNVLKSKWFF YVVKYNRPSS CRELMKNKEI LRFVLRDIPD   720

SQVRRYFKAV QGEEAYASAE AMRTRLVDAL SQFSVTACLD EVGGMTDKEF ASQRAVDSKE   780

KLRAIIRLYL TVAYLITKSM VKVNTRFSIA FSVLERDYYL LIDGKKKSSD YTGEDMLALT   840

RKFVGEDAGL YREWKEKNAE AKDKYFDKAE RKKVLRQNDK MIRKMHFTPH SLNYVQKNLE   900

SVQSNGLAAV IKEYRNAVAH LNIINRLDEY IGSARADSYY SLYCYCLQMY LSKNFSVGYL   960

INVQKQLEEH HTYMKDLMWL LNIPFAYNLA RYKNLSNEKL FYDEEAAAEK ADKAENERGE. 1020
```

Yan et al. (2018) *Mol Cell.* 70(2):327-339 (doi: 10.1016/j.molcel.2018.02.2018) and Konermann et al. (2018) *Cell* 173(3):665-676 (doi: 10.1016/j.cell/2018.02.033) have described CasRX/Cas13d proteins and both of which are incorporated by reference herein in their entireties. Also see WO Publication Nos. WO2018/183703 (CasM) and WO2019/006471 (Cas13d), which are incorporated herein by reference in their entirety.

Exemplary wild type Cas13d proteins of the disclosure may comprise or consist of the amino acid sequence:
Cas13d (*Ruminococcus flavefaciens* XPD3002) Sequence:

```
                                                           (SEQ ID NO: 45)
  1 IEKKKSFAKG MGVKSTLVSG SKVYMTTFAE GSDARLEKIV EGDSIRSVNE GEAFSAEMAD

61 KNAGYKIGNA KFSHPKGYAV VANNPLYTGP VQQDMLGLKE TLEKRYFGES ADGNDNICIQ

121 VIHNILDIEK ILAEYITNAA YAVNNISGLD KDIIGFGKFS TVYTVDEFKD PEHHRAAFNN

181 NDKLINAIKA QYDEFDNFLD NPRLGYFGQA FFSKEGRNYI INYGNECYDI LALLSGLAHW

241 VVANNEEESR ISRTWLYNLD KNLDNEYIST LNYLYDRITN ELTNSFSKNS AANVNYIAET

301 LGINPAEFAE QYFRFSIMKE QKNLGFNITK LREVMLDRKD MSEIRKNHKV FDSIRTKVYT

361 MMDFVIYRYY IEEDAKVAAA NKSLPDNEKS LSEKDIFVIN LRGSFNDDQK DALYYDEANR

421 IWRKLENIMH NIKEFRGNKT REYKKKDAPR LPRILPAGRD VSAFSKLMYA LTMFLDGKEI

481 NDLLTTLINK FDNIQSFLKV MPLIGVNAKF VEEYAFFKDS AKIADELRLI KSFARMGEPI

541 ADARRAMYID AIRILGTNLS YDELKALADT FSLDENGNKL KKGKHGMRNF IINNVISNKR

601 FHYLIRYGDP AHLHEIAKNE AVVKFVLGRI ADIQKKQGQN GKNQIDRYYE TCIGKDKGKS

661 VSEKVDALTK IITGMNYDQF DKKRSVIEDT GRENAEREKF KKIISLYLTV IYHILKNIVN
```

```
721 INARYVIGFH CVERDAQLYK EKGYDINLKK LEEKGFSSVT KLCAGIDETA PDKRKDVEKE

781 MAERAKESID SLESANPKLY ANYIKYSDEK KAEEFTRQIN REKAKTALNA YLRNTKWNVI

841 IREDLLRIDN KTCTLFANKA VALEVARYVH AYINDIAEVN SYFQLYHYIM QRIIMNERYE

901 KSSGKVSEYF DAVNDEKKYN DRLLKLLCVP FGYCIPRFKN LSIEALFDRN EAAKFDKEKK

961 KVSGNS.
```

Exemplary wild type Cas13d proteins of the disclosure may comprise or consist of the amino acid sequence:
Cas13d (contig e-k87_11092736):

(SEQ ID NO: 46)
MKRQKTFAKRIGIKSTVAYGQGKYAITTFGKGSKAEIAVRSADPPEETL

PTESDATLSIHAKFAKAGRDGREFKCGDVDETRIHTSRSEYESLISNPA

ESPREDYLGLKGTLERKFFGDEYPKDNLRIQIIYSILDIQKILGLYVED

ILHFVDGLQDEPEDLVGLGLGDEKMQKLLSKALPYMGFFGSTDVFKVTK

KREERAAADEHNAKVFRALGAIRQKLAHFKWKESLAIFGANANMPIRFF

QGATGGRQLWNDVIAPLWKKRIERVRKSFLSNSAKNLWVLYQVFKDDTD

EKKKARARQYYHFSVLKEGKNLGFNLTKTREYFLDKFFPIFHSSAPDVK

RKVDTFRSKFYAILDFIIYEASVSVANSGQMGKVAPWKGAIDNALVKLR

EAPDEEAKEKIYNVLAASIRNDSLFLRLKSACDKFGAEQNRPVFPNELR

NNRDIRNVRSEWLEATQDVDAAAFVQLIAFLCNFLEGKEINELVTALIK

KFEGIQALIDLLRNLEGVDSIRFENEFALFNDDKGNMAGRIARQLRLLA

SVGKMKPDMTDAKRVLYKSALEILGAPPDEVSDEWLAENILLDKSNNDY

QKAKKTVNPFRNYIAKNVITSRSFYYLVRYAKPTAVRKLMSNPKIVRYV

LKRLPEKQVASYYSAIWTQSESNSNEMVKLIEMIDRLTTEIAGFSFAVL

KDKKDSIVSASRESRAVNLEVERLKKLTTLYMSIAYIAVKSLVKVNARY

FIAYSALERDLYFFNEKYGEEFRLHFIPYELNGKTCQFEYLAILKYYLA

RDEETLKRKCEICEEIKVGCEKHKKNANPPYEYDQEWIDKKKALNSERK

ACERRLHFSTHWAQYATKRDENMAKHPQKWYDILASHYDELLALQATGW

LATQARNDAEHLNPVNEFDVYIEDLRRYPEGTPKNKDYHIGSYFEIYHY

IRQRAYLEEVLAKRKEYRDSGSFTDEQLDKLQKILDDIRARGSYDKNLL

KLEYLPFAYNLPRYKNLTTEALFDDDSVSGKKRVAEWREREKTREAERE

QRRQR.

An exemplary direct repeat sequence of Cas13d (contig e-k87_11092736) (SEQ ID NO: 46) comprises or consists of the nucleic acid sequence: Cas13d (contig e-k87_11092736) Direct Repeat Sequence): GTGAGAAGTCTCCTTATGGGGAGATGCTAC (SEQ ID NO: 47).

Exemplary wild type Cas13d proteins of the disclosure may comprise or consist of the amino acid sequence:
Cas13d (160582958_gene49834):

(SEQ ID NO: 48)
MKNSVTFKLIQAQENKEAARKKAKDIAEQARIAKRNGVVKKEENRINRI

QIEIQTQKKSNTQNAYHLKSLAKAAGVKSVFAIGNDLLMTGFGPGNDAT

IEKRVFQNRAIETLSSPEQYSAEFQNKQFKIKGNIKVLNHSTQKMEEIQ

TELQDNYNRPHFDLLGCKNVLEQKYFGRTFSDNIHVQIAYNIMDIEKLL

TPYINNIIYTLNELMRDNSKDDFFGCDSHFSVAYLYDELKAGYSDRLKT

KPNLSKNIDRIWNNFCNYMNSDSGNTEARLAYFGELFYKPKETGDAKSD

YKTHLSNNQKEEWELKSDKEVYNIFAILCDLRHFCTHGESITPSGKPFP

YNLEKNLFPEAKQVLNSLFEEKAESLGAEAFGKTAGKTDVSILLKVFEK

EQASQKEQQALLKEYYDFKVQKTYKNMGFSIKKLREAIMEIPDAAKFKD

DLYSSLRHKLYGLFDFILVKHFLDTSDSENLQNNDIFRQLRACRCEEEK

DQVYRSIAVKVWEKVKKKELNMFKQVVVIPSLSKDELKQMEMTKNTELL

SSIETISTQASLFSEMIFMMTYLLDGKEINLLCTSLIEKFENIASFNEV

LKSPQIGYETKYTEGYAFFKNADKTAKELRQVNNMARMTKPLGGVNTKC

VMYNEAAKILGAKPMSKAELESVFNLDNHDYTYSPSGKKIPNKNFRNFI

INNVITSRRFLYLIRYGNPEKIRKIAINPSIISFVLKQIPDEQIKRYYP

PCIGKRTDDVTLMRDELGKMLQSVNFEQFSRVNNKQNAKQNPNGEKARL

QACVRLYLTVPYLFIKNMVNINARYVLAFHCLERDHALCFNSRKLNDDS

YNEMANKFQMVRKAKKEQYEKEYKCKKQETGTAHTKKIEKLNQQIAYID

KDIKNMHSYTCRNYRNLVAHLNVVSKLQNYVSELPNDYQITSYFSFYHY

CMQLGLMEKVSSKNIPLVESLKNEANDAQSYSAKKTLEYFDLIEKNRTY

CKDFLKALNAPFSYNLPRFKNLSIEALFDKNIVYEQADLKKE.

An exemplary direct repeat sequence of Cas13d (160582958_gene49834) (SEQ ID NO: 48) comprises or consists of the nucleic acid sequence:
Cas13d (160582958_gene49834) Direct Repeat Sequence:

(SEQ ID NO: 49)
GAACTACACCCCTCTGTTCTTGTAGGGGTCTAACAC.

Exemplary wild type Cas13d proteins of the disclosure may comprise or consist of the amino acid sequence:
Cas13d (contig tpg|DJXD01000002.1|; uncultivated *Ruminococcus* assembly, UBA7013, from sheep gut metagenome):

(SEQ ID NO: 50)
MKKQKSKKTVSKTSGLKEALSVQGTVIMTSFGKGNMANLSYKIPSSQKPQ

NLNSSAGLKNVEVSGKKIKFQGRHPKIATTDNPLFKPQPGMDLLCLKDK

LEMHYFGKTFDDNIHIQLIYQILDIEKILAVHVNNIVFTLDNVLHPQKE

ELTEDFIGAGGWRINLDYQTLRGQTNKYDRFKNYIKRKELLYFGEAFYH

ENERRYEEDIFAILTLLSALRQFCFHSDLSSDESDHVNSFWLYQLEDQL

-continued
SDEFKETLSILWEEVTERIDSEFLKTNTVNLHILCHVFPKESKETIVRA

YYEFLIKKSFKNMGFSIKKLREIMLEQSDLKSFKEDKYNSVRAKLYKLF

DFIITYYYDHHAFEKEALVSSLRSSLTEENKEEIYIKTARTLASALGAD

FKKAAADVNAKNIRDYQKKANDYRISFEDIKIGNTGIGYFSELIYMLIL

LLDGKEINDLLTTLINKFDNIISFIDILKKLNLEFKFKPEYADFFNMTN

CRYTLEELRVINSIARMQKPSADARKIMYRDALRILGMDNRPDEEIDRE

LERTMPVGADGKFIKGKQGFRNFIASNVIESSRFHYLVRYNNPHKTRTL

VKNPNVVKFVLEGIPETQIKRYFDVCKGQEIPPTSDKSAQIDVLARIIS

SVDYKIFEDVPQSAKINKDDPSRNFSDALKKQRYQAIVSLYLTVMYLIT

KNLVYVNSRYVIAFHCLERDAFLHGVTLPKMNKKIVYSQLTTHLLTDKN

YTTYGHLKNQKGHRKWYVLVKNNLQNSDITAVSSFRNIVAHISVVRNSN

EYISGIGELHSYFELYHYLVQSMIAKNNWYDTSHQPKTAEYLNNLKKHH

TYCKDFVKAYCIPFGYVVPRYKNLTINELFDRNNPNPEPKEEV.

An exemplary direct repeat sequence of Cas13d (contig tpg|DJXD01000002.1|; uncultivated *Ruminococcus* assembly, UBA7013, from sheep gut metagenome) (SEQ ID NO: 50) comprises or consists of the nucleic acid sequence: Cas13d (contig tpg|DJXD01000002.1|; uncultivated *Ruminococcus* assembly, UBA7013, from sheep gut metagenome) Direct Repeat Sequence: CAACTACAACCCCG-TAAAAATACGGGGTTCTGAAAC (SEQ ID NO: 51).

gRNA Target Sequences

In some embodiments of the compositions of the disclosure, a target sequence of an RNA molecule comprises a sequence motif corresponding to the first RNA binding protein and/or the second RNA binding protein.

In some embodiments of the compositions and methods of the disclosure, the sequence motif is a signature of a disease or disorder.

A sequence motif of the disclosure may be isolated or derived from a sequence of foreign or exogenous sequence found in a genomic sequence, and therefore translated into an mRNA molecule of the disclosure or a sequence of foreign or exogenous sequence found in an RNA sequence of the disclosure.

A sequence motif of the disclosure may comprise or consist of a mutation in an endogenous sequence that causes a disease or disorder. The mutation may comprise or consist of a sequence substitution, inversion, deletion, insertion, transposition, or any combination thereof.

A sequence motif of the disclosure may comprise or consist of a repeated sequence. In some embodiments, the repeated sequence may be associated with a microsatellite instability (MSI). MSI at one or more loci results from impaired DNA mismatch repair mechanisms of a cell of the disclosure. A hypervariable sequence of DNA may be transcribed into an mRNA of the disclosure comprising a target sequence comprising or consisting of the hypervariable sequence.

A sequence motif of the disclosure may comprise or consist of a biomarker. The biomarker may indicate a risk of developing a disease or disorder. The biomarker may indicate a healthy gene (low or no determinable risk of developing a disease or disorder. The biomarker may indicate an edited gene. Exemplary biomarkers include, but are not limited to, single nucleotide polymorphisms (SNPs), sequence variations or mutations, epigenetic marks, splice acceptor sites, exogenous sequences, heterologous sequences, and any combination thereof.

A sequence motif of the disclosure may comprise or consist of a secondary, tertiary or quaternary structure. The secondary, tertiary or quaternary structure may be endogenous or naturally occurring. The secondary, tertiary or quaternary structure may be induced or non-naturally occurring. The secondary, tertiary or quaternary structure may be encoded by an endogenous, exogenous, or heterologous sequence.

In some embodiments of the compositions and methods of the disclosure, a target sequence of an RNA molecule comprises or consists of between 2 and 100 nucleotides or nucleic acid bases, inclusive of the endpoints. In some embodiments, the target sequence of an RNA molecule comprises or consists of between 2 and 50 nucleotides or nucleic acid bases, inclusive of the endpoints. In some embodiments, the target sequence of an RNA molecule comprises or consists of between 2 and 20 nucleotides or nucleic acid bases, inclusive of the endpoints.

In some embodiments of the compositions and methods of the disclosure, a target sequence of an RNA molecule is continuous. In some embodiments, the target sequence of an RNA molecule is discontinuous. For example, the target sequence of an RNA molecule may comprise or consist of one or more nucleotides or nucleic acid bases that are not contiguous because one or more intermittent nucleotides are positioned in between the nucleotides of the target sequence.

In some embodiments of the compositions and methods of the disclosure, a target sequence of an RNA molecule is naturally occurring. In some embodiments, the target sequence of an RNA molecule is non-naturally occurring. Exemplary non-naturally occurring target sequences may comprise or consist of sequence variations or mutations, chimeric sequences, exogenous sequences, heterologous sequences, chimeric sequences, recombinant sequences, sequences comprising a modified or synthetic nucleotide or any combination thereof.

In some embodiments of the compositions and methods of the disclosure, a target sequence of an RNA molecule binds to a guide RNA of the disclosure.

In some embodiments of the compositions and methods of the disclosure, a target sequence of an RNA molecule binds to a first RNA binding protein of the disclosure.

In some embodiments of the compositions and methods of the disclosure, a target sequence of an RNA molecule binds to a second RNA binding protein of the disclosure.

RNA Molecules

In some embodiments of the compositions and methods of the disclosure, an RNA molecule of the disclosure comprises a target sequence. In some embodiments, the RNA molecule of the disclosure comprises at least one target sequence. In some embodiments, the RNA molecule of the disclosure comprises one or more target sequence(s). In some embodiments, the RNA molecule of the disclosure comprises two or more target sequences.

In some embodiments of the compositions and methods of the disclosure, an RNA molecule of the disclosure is a naturally occurring RNA molecule. In some embodiments, the RNA molecule of the disclosure is a non-naturally occurring molecule. Exemplary non-naturally occurring RNA molecules may comprise or consist of sequence variations or mutations, chimeric sequences, exogenous sequences, heterologous sequences, chimeric sequences, recombinant sequences, sequences comprising a modified or synthetic nucleotide or any combination thereof.

In some embodiments of the compositions and methods of the disclosure, an RNA molecule of the disclosure comprises or consists of a sequence isolated or derived from a virus.

In some embodiments of the compositions and methods of the disclosure, an RNA molecule of the disclosure comprises or consists of a sequence isolated or derived from a prokaryotic organism. In some embodiments, an RNA molecule of the disclosure comprises or consists of a sequence isolated or derived from a species or strain of archaea or a species or strain of bacteria.

In some embodiments of the compositions and methods of the disclosure, the RNA molecule of the disclosure comprises or consists of a sequence isolated or derived from a eukaryotic organism. In some embodiments, an RNA molecule of the disclosure comprises or consists of a sequence isolated or derived from a species of protozoa, parasite, protist, algae, fungi, yeast, amoeba, worm, microorganism, invertebrate, vertebrate, insect, rodent, mouse, rat, mammal, or a primate. In some embodiments, an RNA molecule of the disclosure comprises or consists of a sequence isolated or derived from a human.

In some embodiments of the compositions and methods of the disclosure, the RNA molecule of the disclosure comprises or consists of a sequence derived from a coding sequence from a genome of an organism or a virus. In some embodiments, the RNA molecule of the disclosure comprises or consists of a primary RNA transcript, a precursor messenger RNA (pre-mRNA) or messenger RNA (mRNA). In some embodiments, the RNA molecule of the disclosure comprises or consists of a gene product that has not been processed (e.g. a transcript). In some embodiments, the RNA molecule of the disclosure comprises or consists of a gene product that has been subject to post-transcriptional processing (e.g. a transcript comprising a 5' cap and a 3' polyadenylation signal). In some embodiments, the RNA molecule of the disclosure comprises or consists of a gene product that has been subject to alternative splicing (e.g. a splice variant). In some embodiments, the RNA molecule of the disclosure comprises or consists of a gene product that has been subject to removal of non-coding and/or intronic sequences (e.g. a messenger RNA (mRNA)).

In some embodiments of the compositions and methods of the disclosure, the RNA molecule of the disclosure comprises or consists of a sequence derived from a non-coding sequence (e.g. a non-coding RNA (ncRNA)). In some embodiments, the RNA molecule of the disclosure comprises or consists of a ribosomal RNA. In some embodiments, the RNA molecule of the disclosure comprises or consists of a small ncRNA molecule. Exemplary small RNA molecules of the disclosure include, but are not limited to, microRNAs (miRNAs), small interfering (siRNAs), piwi-interacting RNAs (piRNAs), small nucleolar RNAs (snoRNAs), small nuclear RNAs (snRNAs), extracellular or exosomal RNAs (exRNAs), and small Cajal body-specific RNAs (scaRNAs). In some embodiments, the RNA molecule of the disclosure comprises or consists of a long ncRNA molecule. Exemplary long RNA molecules of the disclosure include, but are not limited to, X-inactive specific transcript (Xist) and HOX transcript antisense RNA (HOTAIR).

In some embodiments of the compositions and methods of the disclosure, the RNA molecule of the disclosure contacted by a composition of the disclosure in an intracellular space. In some embodiments, the RNA molecule of the disclosure contacted by a composition of the disclosure in a cytosolic space. In some embodiments, the RNA molecule of the disclosure contacted by a composition of the disclosure in a nucleus. In some embodiments, the RNA molecule of the disclosure contacted by a composition of the disclosure in a vesicle, membrane-bound compartment of a cell, or an organelle.

In some embodiments of the compositions and methods of the disclosure, the RNA molecule of the disclosure contacted by a composition of the disclosure in an extracellular space. In some embodiments, the RNA molecule of the disclosure contacted by a composition of the disclosure in an exosome. In some embodiments, the RNA molecule of the disclosure contacted by a composition of the disclosure in a liposome, a polymersome, a micelle or a nanoparticle. In some embodiments, the RNA molecule of the disclosure contacted by a composition of the disclosure in an extracellular matrix. In some embodiments, the RNA molecule of the disclosure contacted by a composition of the disclosure in a droplet. In some embodiments, the RNA molecule of the disclosure contacted by a composition of the disclosure in a microfluidic droplet.

In some embodiments of the compositions and methods of the disclosure, a RNA molecule of the disclosure comprises or consists of a single-stranded sequence. In some embodiments, the RNA molecule of the disclosure comprises or consists of a double-stranded sequence. In some embodiments, the double-stranded sequence comprises two RNA molecules. In some embodiments, the double-stranded sequence comprises one RNA molecule and one DNA molecule. In some embodiments, including those wherein the double-stranded sequence comprises one RNA molecule and one DNA molecule, compositions of the disclosure selectively bind and, optionally, selectively cut the RNA molecule.

RNA-Binding Endonucleases

In some embodiments of the compositions of the disclosure, the second RNA binding protein comprises or consists of a nuclease domain. In some embodiments, the second RNA binding protein binds RNA in a manner in which it associates with RNA. In some embodiments, the second RNA binding protein associates with RNA in a manner in which it cleaves RNA.

In some embodiments of the compositions of the disclosure, the second RNA binding protein comprises or consists of an RNAse.

In some embodiments, the second RNA binding protein comprises or consists of an RNAse1. In some embodiments, the RNAse1 protein comprises or consists of:

```
                                         (SEQ ID NO: 20)
KESRAKKFQRQHMDSDSSPSSSSTYCNQMMRRRNMTQGLCKPVNTFVHE

PLVDVQNVCFQEKVTCKNGQGNCYKSNSSMHITDCRLTNGSRYPNCAYR

TSPKERHIIVACEGSPYVPVHFDASVEDST.
```

In some embodiments, the second RNA binding protein comprises or consists of an RNAse4. In some embodiments, the RNAse4 protein comprises or consists of:

```
                                         (SEQ ID NO: 21)
QDGMYQRFLRQHVHPEETGGSDRYCDLMMQRRKMTLYHCKRFNTFIHED

IWNIRSICSTTNIQCKNGKMNCHEGVVKVTDCRDTGSSRAPNCRYRAIA

STRRVVIACEGNPQVPVHFDG.
```

In some embodiments, the second RNA binding protein comprises or consists of an RNAse6. In some embodiments, the RNAse6 protein comprises or consists of:

(SEQ ID NO: 22)
WPKRLTKAHWFEIQHIQPSPLQCNRAMSGINNYTQHCKHQNTFLHDSFQ

NVAAVCDLLSIVCKNRRHNCHQSSKPVNIVITDCRLTSGKYPQCRYSAA

AQYKFFIVACDPPQKSDPPYKLVPVHLDSIL.

In some embodiments, the second RNA binding protein comprises or consists of an RNAse7. In some embodiments, the RNAse7 protein comprises or consists of:

(SEQ ID NO: 23)
APARAGFCPLLLLLLLGLWVAEIPVSAKPKGMTSSQWFKIQHMQPSPQ

ACNSAMKNINKHTKRCKDLNTFLHEPFSSVAATCQTPKIACKNGDKNC

HQSHGPVSLTMCKLTSGKYPNCRYKEKRQNKSYVVACKPPQKKDSQQF

HLVPVHLDRVL.

In some embodiments, the second RNA binding protein comprises or consists of an RNAse8. In some embodiments, the RNAse8 protein comprises or consists of:

(SEQ ID NO: 24)
TSSQWFKTQHVQPSPQACNSAMSIINKYTERCKDLNTFLHEPFSSVAIT

CQTPNIACKNSCKNCHQSHGPMSLTMGELTSGKYPNCRYKEKHLNTPYI

VACDPPQQGDPGYPLVPVHLDKVV.

In some embodiments, the second RNA binding protein comprises or consists of an RNAse2. In some embodiments, the RNAse2 protein comprises or consists of:

(SEQ ID NO: 25)
KPPQFTWAQWFETQHINMTSQQCTNAMQVINNYQRRCKNQNTFLLTTFA

NVVNVCGNPNMTCPSNKTRKNCHHSGSQVPLIHCNLTTPSPQNISNCRY

AQTPANMFYIVACDNRDQRRDPPQYPVVPVHLDRII.

In some embodiments, the second RNA binding protein comprises or consists of an RNAse6PL. In some embodiments, the RNAse6PL protein comprises or consists of:

(SEQ ID NO: 26)
DKRLRDNHEWKKLIMVQHWPETVCEKIQNDCRDPPDYWTIHGLWPDKSE

GCNRSWPFNLEEIKKNWMEITDSSLPSPSMGPAPPRWMRSTPRRSTLAE

AWNSTGSWTSTGGCALPPAALPSGDLCCRPSLTAGSRGVGVDLTALHQL

LHVHYSATGIIPEECSEPTKPFQIILHHDHTEWVQSIGMPIWGTISSSE

SAIGKNEESQPACAVLSHDS.

In some embodiments, the second RNA binding protein comprises or consists of an RNAseL. In some embodiments, the RNAseL protein comprises or consists of:

(SEQ ID NO: 27)
AAVEDNHLLIKAVQNEDVDLVQQLLEGGANVNFQEEEGGWTPLHNAVQM

SREDIVELLLRHGADPVLRKKNGATPFILAAIAGSVKdLLKLFLSKGAD

VNECDFYGFTAFMEAAVYGKVKALKFLYKRGANVNLRRKTKEDQERLRK

GGATALMDAAEKGHVEVLKILLDEMGADVNACDNMGRNALIHALLSSDD

SDVEAITHLLLDHGADVNVRGERGKTPLILAVEKKHLGLVQRLLEQEHI

EINDTDSDGKTALLLAVELKLKKIAELLCKRGASTDCGDLVMTARRNYD

HSLVKVLLSHGAKEDFHPPAEDWKPQSSHWGAALKDLHRIYRPMIGKLK

FFIDEKYKIADTSEGGIYLGFYEKQEVAVKTFCEGSPRAQREVSCLQSS

RENSHLVTFYGSESHRGHLFVCVTLCEQTLEACLDVHRGEDVENEEDEF

ARNVLSSIFKAVQELHLSCGYTHQDLQPQNILIDSKKAAHLADFDKSIK

WAGDPQEVKRDLEDLGRLVLYVVKKGSISFEDLKAQSNEEVVQLSPDEE

TKDLIHRLFHPGEHVRDCLSDLLGHPFFWTWESRYRTLRNVGNESDIKT

RKSESEILRLLQPGPSEHSKSFDKWTTKINECVMKKMNKFYEKRGNFYQ

NTVGDLLKFIRNLGEHIDEEKHKKMKLKIGDPSLYFQKTFPDLVIYVYT

KLQNTEYRKHFPQTHSPNKPQCDGAGGASGLASPGC.

In some embodiments, the second RNA binding protein comprises or consists of an RNAseT2. In some embodiments, the RNAseT2 protein comprises or consists of:

(SEQ ID NO: 28)
VQHWPETVCEKIQNDCRDPPDYWTIHGLWPDKSEGCNRSWPFNLEEIKD

LLPEMRAYWPDVIHSFPNRSRFWKHEWEKHGTCAAQVDALNSQKKYFGR

SLELYRELDLNSVLLKLGIKPSINYYQVADFKDALARVYGVIPKIQCLP

PSQDEEVQTIGQIELCLTKQDQQLQNCTEPGEQPSPKQEVWLANGAAES

RGLRVCEDGPVFYPPPKKTKH.

In some embodiments, the second RNA binding protein comprises or consists of an RNAse11. In some embodiments, the RNAse11 protein comprises or consists of:

(SEQ ID NO: 29)
EASESTMKIIKEEFTDEEMQYDMAKSGQEKQTIEILMNPILLVKNTSLS

MSKDDMSSTLLTFRSLHYNDPKGNSSGNDKECCNDMTVWRKVSEANGSC

KWSNNFIRSSTEVMRRVHRAPSCKFVQNPGISCCESLELENTVCQFTTG

KQFPRCQYHSVTSLEKILTVLTGHSLMSWLVCGSKL.

In some embodiments, the second RNA binding protein comprises or consists of an RNAseT2-like. In some embodiments, the RNAseT2-like protein comprises or consists of:

(SEQ ID NO: 30)
XLGGADKRLRDNHEWKKLIMVQHWPETVCEKIQNDCRDPPDYWTIHGLW

PDKSEGCNRSWPFNLEEIKDLLPEMRAYWPDVIHSFPNRSRFWKHEWEK

HGTCAAQVDALNSQKKYFGRSLELYRELDLNSVLLKLGIKPSINYYQTT

EEDLNLDVEPTTEDTAEEVTIHVLLHSALFGEIGPRRW.

In some embodiments of the compositions of the disclosure, the second RNA binding protein comprises or consists of a mutated RNAse.

In some embodiments, the second RNA binding protein comprises or consists of a mutated Rnase1 (Rnase1(K41R)) polypeptide. In some embodiments, the Rnase1(K41R) polypeptide comprises or consists of:

(SEQ ID NO: 116)
KESRAKKFQRQHMDSDSSPSSSSTYCNQMMRRRNMTQGRCRPVNTFVHEPL

VDVQNVCFQEKVTCKNGQGNCYKSNSSMHITDCRLTNGSRYPNCAYRTSPK

ERHIIVACEGSPYVPVHFDASVEDST.

In some embodiments, the second RNA binding protein comprises or consists of a mutated Rnase1 (Rnase1(K41R, D121E)) polypeptide. In some embodiments, the Rnase1 (Rnase1(K41R, D121E)) polypeptide comprises or consists of:

(SEQ ID NO: 117)
KESRAKKFQRQHMDSDSSPSSSSTYCNQMMRRRNMTQGRCRPVNTFVHEPL

VDVQNVCFQEKVTCKNGQGNCYKSNSSMHITDCRLTNGSRYPNCAYRTSPK

ERHIIVACEGSPYVPVHFEASVEDST.

In some embodiments, the second RNA binding protein comprises or consists of a mutated Rnase1 (Rnase1(K41R, D121E, H119N)) polypeptide. In some embodiments, the Rnase1 (Rnase1(K41R, D121E, H119N)) polypeptide comprises or consists of:

(SEQ ID NO: 118)
KESRAKKFQRQHMDSDSSPSSSSTYCNQMMRRRNMTQGRCRPVNTFVHEPL

VDVQNVCFQEKVTCKNGQGNCYKSNSSMHITDCRLTNGSRYPNCAYRTSPK

ERHIIVACEGSPYVPVNFEASVEDST.

In some embodiments, the second RNA binding protein comprises or consists of a mutated Rnase1. In some embodiments, the second RNA binding protein comprises or consists of a mutated Rnase1 (Rnase1(H119N)) polypeptide. In some embodiments, the Rnase1 (Rnase1(H119N)) polypeptide comprises or consists of:

(SEQ ID NO: 119)
KESRAKKFQRQHMDSDSSPSSSSTYCNQMMRRRNMTQGRCKPVNTFVHEPL

VDVQNVCFQEKVTCKNGQGNCYKSNSSMHITDCRLTNGSRYPNCAYRTSPK

ERHIIVACEGSPYVPVNFDASVEDST.

In some embodiments, the second RNA binding protein comprises or consists of a mutated Rnase1 (Rnase1(R39D, N67D, N88A, G89D, R91D, H119N)) polypeptide. In some embodiments, the Rnase1 (Rnase1(R39D, N67D, N88A, G89D, R91D, H119N)) polypeptide comprises or consists of: KESRAKKFQRQHMDSDSSPSSSSTYCNQMMRRRNMTQGDCKPVNTFVHEPLVDVQNV CFQEKVTCKDGQGNCYKSNSSMHITDCRLTADSDYPNCAYRTSPKERHIIVACEGSPYV PVNFDASVEDST (SEQ ID NO: 120). In some embodiments, the second RNA binding protein comprises or consists of a mutated Rnase1 (Rnase1 (R39D, N67D, N88A, G89D, R91D, H119N)) polypeptide. In some embodiments, the Rnase1 (Rnase1(R39D, N67D, N88A, G89D, R91D, H119N, K41R, D121E)) polypeptide comprises or consists of:

(SEQ ID NO: 121)
KESRAKKFQRQHMDSDSSPSSSSTYCNQMMRRRNMTQGDCRPVNTFVHEPL

VDVQNVCFQEKVTCKDGQGNCYKSNSSMHITDCRLTADSDYPNCAYRTSPK

ERHIIVACEGSPYVPVNFEASVEDST.

In some embodiments, the second RNA binding protein comprises or consists of a mutated Rnase1 (Rnase1(R39D, N67D, N88A, G89D, R91D, H119N)) polypeptide. In some embodiments, the Rnase1 (Rnase1(R39D, N67D, N88A, G89D, R91D)) polypeptide comprises or consists of:

(SEQ ID NO: 122)
KESRAKKFQRQHMDSDSSPSSSSTYCNQMMRRRNMTQGDCKPVNTFVHEPL

VDVQNVCFQEKVTCKDGQGNCYKSNSSMHITDCRLTADSDYPNCAYRTSPK

ERHIIVACEGSPYVPVHFDASVEDST.

In some embodiments, the second RNA binding protein comprises or consists of a mutated Rnase1 (Rnase1 (R39D, N67D, N88A, G89D, R91D, H119N, K41R, D121E)) polypeptide that comprises or consists of:

(SEQ ID NO: 208)
KESRAKKFQRQHMDSDSSPSSSSTYCNQMMRRRNMTQGDCRPVNTFVHEPL

VDVQNVCFQEKVTCKDGQGNCYKSNSSMHITDCRLTADSDYPNCAYRTSPK

ERHIIVACEGSPYVPVNFEASVEDST.

In some embodiments of the compositions of the disclosure, the second RNA binding protein comprises or consists of a NOB1 polypeptide. In some embodiments, the NOB1 polypeptide comprises or consists of:

(SEQ ID NO: 31)
APVEHVVADAGAFLRHAALQDIGKNIYTIREVVTEIRDKATRRRLAVLPYE

LRFKEPLPEYVRLVTEFSKKTGDYPSLSATDIQVLALTYQLEAEFVGVSHL

KQEPQKVKVSSSIQHPETPLHISGFHLPYKPKPPQETEKGHSACEPENLEF

SSFMFWRNPLPNIDHELQELLIDRGEDVPSEEEEEEENGFEDRKDDSDDDG

GGWITPSNIKQIQQELEQCDVPEDVRVGCLTTDFAMQNVLLQMGLHVLAVN

GMLIREARSYILRCHGCFKTTSDMSRVFCSHCGNKTLKKVSVTV.

In some embodiments of the compositions of the disclosure, the second RNA binding protein comprises or consists of an endonuclease. In some embodiments, the second RNA binding protein comprises or consists of an endonuclease V (ENDOV). In some embodiments, the ENDOV protein comprises or consists of:

(SEQ ID NO: 32)
AFSGLQRVGGVDVSFVKGDSVRACASLVVLSFPELEVVYEESRMVSLTAPY

VSGFLAFREVPFLLELVQQLREKEPGLMPQVLLVDGNGVLHHRGFGVACHL

GVLTDLPCVGVAKKLLQVDGLENNALHKEKIRLLQTRGDSFPLLGDSGTVL

GMALRSHDRSTRPLYISVGHRMSLEAAVRLTCCCCRFRIPEPVRQADICSR

EHIRKS.

In some embodiments, the second RNA binding protein comprises or consists of an endonuclease G (ENDOG). In some embodiments, the ENDOG protein comprises or consists of:

(SEQ ID NO: 33)
AELPPVPGGPRGPGELAKYGLPGLAQLKSRESYVLCYDPRTRGALWVVEQL

RPERLRGDGDRRECDFREDDSVHAYHRATNADYRGSGFDRGHLAAAANHRW

SQKAMDDTFYLSNVAPQVPHLNQNAWNNLEKYSRSLTRSYQNVYVCTGPLF

LPRTEADGKSYVKYQVIGKNHVAVPTHFFKVLILEAAGGQIELRTYVMPNA

PVDEAIPLERFLVPIESIERASGLLFVPNILARAGSLKAITAGSK.

In some embodiments, the second RNA binding protein comprises or consists of an endonuclease D1 (ENDOD1). In some embodiments, the ENDOD1 protein comprises or consists of:

(SEQ ID NO: 34)
RLVGEEEAGFGECDKFFYAGTPPAGLAADSHVKICQRAEGAERFATLYSTR

DRIPVYSAFRAPRPAPGGAEQRWLVEPQIDDPNSNLEEAINEAEAITSVNS

LGSKQALNTDYLDSDYQRGQLYPFSLSSDVQVATFTLTNSAPMTQSFQERW

YVNLHSLMDRALTPQCGSGEDLYILTGTVPSDYRVKDKVAVPEFVWLAACC

AVPGGGWAMGFVKHTRDSDIIEDVMVKDLQKLLPFNPQLFQNNCGETEQDT

EKMKKILEVVNQIQDEERMVQSQKSSSPLSSTRSKRSTLLPPEASEGSSSF

LGKLMGFIATPFIKLFQLIYYLVVAILKNIVYFLWCVTKQVINGIESCLYR

LGSATISYFMAIGEELVSIPWKVLKVVAKVIRALLRILCCLLKAICRVLSI

PVRVLVDVATFPVYTMGAIPIVCKDIALGLGGTVSLLFDTAFGTLGGLFQV

VFSVCKRIGYKVTFDNSGEL.

In some embodiments, the second RNA binding protein comprises or consists of a Human flap endonuclease-1 (hFEN1). In some embodiments, the hFEN1 polypeptide comprises or consists of:

(SEQ ID NO: 35)
MGIQGLAKLIADVAPSAIRENDIKSYFGRKVAIDASMSIYQFLIAVRQGGD

VLQNEEGETTSHLMGMFYRTIRMMENGIKPVYVFDGKPPQLKSGELAKRSE

RRAEAEKQLQQAQAAGAEQEVEKFTKRLVKVTKQHNDECKHLLSLMGIPYL

DAPSEAEASCAALVKAGKVYAAATEDMDCLTFGSPVLMRHLTASEAKKLPI

QEFHLSRILQELGLNQEQFVDLCILLGSDYCESIRGIGPKRAVDLIQKHKS

IEEIVRRLDPNKYPVPENWLHKEAHQLFLEPEVLDPESVELKWSEPNEEEL

IKFMCGEKQFSEERIRSGVKRLSKSRQGSTQGRLDDFFKVTGSLSSAKRKE

PEPKGSTKKKAKTGAAGKFKRGK.

In some embodiments, the second RNA binding protein comprises or consists of a DNA repair endonuclease XPF (ERCC4) polypeptide. In some embodiments, the ERCC4 polypeptide comprises or consists of:

(SEQ ID NO: 124)
MESGQPARRIAMAPLLEYERQLVLELLDTDGLVVCARGLGADRLLYHFLQL

HCHPACLVLVLNTQPAEEEYFINQLKIEGVEHLPRRVTNEITSNSRYEVYT

QGGVIFATSRILVVDFLTDRIPSDLITGILVYRAHRIIESCQEAFILRLFR

QKNKRGFIKAFTDNAVAFDTGFCHVERVMRNLFVRKLYLWPRFHVAVNSFL

EQHKPEVVEIHVSMTPTMLAIQTAILDILNACLKELKCHNPSLEVEDLSLE

NAIGKPFDKTIRHYLDPLWHQLGAKTKSLVQDLKILRTLLQYLSQYDCVTF

LNLLESLRATEKAFGQNSGWLFLDSSTSMFINARARVYHLPDAKMSKKEKI

SEKMEIKEGEGILWG.

In some embodiments of the compositions of the disclosure, the second RNA binding protein comprises or consists of an Endonuclease III-like protein 1 (NTHL) polypeptide. In some embodiments, the NTHL polypeptide comprises or consists of:

(SEQ ID NO: 123)
CSPQESGMTALSARMLTRSRSLGPGAGPRGCREEPGPLRRREAAAEARKSH

SPVKRPRKAQRLRVAYEGSDSEKGEGAEPLKVPVWEPQDWQQQLVNIRAMR

NKKDAPVDHLGTEHCYDSSAPPKVRRYQVLLSLMLSSQTKDQVTAGAMQRL

RARGLTVDSILQTDDATLGKLIYPVGFWRSKVKYIKQTSAILQQHYGGDIP

ASVAELVALPGVGPKMAHLAMAVAWGTVSGIAVDTHVHRIANRLRWTKKAT

KSPEETRAALEEWLPRELWHEINGLLVGFGQQTCLPVHPRCHACLNQALCP

AAQGL.

In some embodiments of the compositions of the disclosure, the second RNA binding protein comprises or consists of a human Schlafen 14 (hSLFN14) polypeptide. In some embodiments, the hSLFN14 polypeptide comprises or consists of:

(SEQ ID NO: 36)
ESTHVEFKRFTTKKVIPRIKEMLPHYVSAFANTQGGYVLIGVDDKSKEVVG

CKWEKVNPDLLKKEIENCIEKLPTFHFCCEKPKVNFTTKILNVYQKDVLDG

YVCVIQVEPFCCVVFAEAPDSWIMKDNSVTRLTAEQWVVMMLDTQSAPPSL

VTDYNSCLISSASSARKSPGYPIKVHKFKEALQ.

In some embodiments of the compositions of the disclosure, the second RNA binding protein comprises or consists of a human beta-lactamase-like protein 2 (hLACTB2) polypeptide. In some embodiments, the hLACTB2 polypeptide comprises or consists of:

(SEQ ID NO: 37)
TLQGTNTYLVGTGPRRILIDTGEPAIPEYISCLKQALTEFNTAIQEIVVTH

WHRDHSGGIGDICKSINNDTTYCIKKLPRNPQREEIIGNGEQQYVYLKDGD

VIKTEGATLRVLYTPGHTDDHMALLLEEENAIFSGDCILGEGTTVFEDLYD

YMNSLKELLKIKADIIYPGHGPVIHNAEAKIQQYISHRNIREQQILTLFRE

NFEKSFTVMELVKIIYKNTPENLHEMAKHNLLLHLKKLEKEGKIFSNTDPD

KKWKAHL.

In some embodiments of the compositions of the disclosure, the second RNA binding protein comprises or consists of an apurinic/apyrimidinic (AP) endodeoxyribonuclease (APEX) polypeptide. In some embodiments, the second RNA binding protein comprises or consists of an apurinic/apyrimidinic (AP) endodeoxyribonuclease (APEX2) polypeptide. In some embodiments, the APEX2 polypeptide comprises or consists of:

(SEQ ID NO: 38)
MLRVVSWNINGIRRPLQGVANQEPSNCAAVAVGRILDELDADIVCLQETKVTRDALTEPLAIVEGYNSYFSFSRNRSGYSGVATFCKDNATPVAAEEGLSGLFATQNGDVGCYGNMDEFTQEELRALDSEGRALLTQHKIRTWEGKEKTLTLINVYCPHADPGRPERLVFKMRFYRLLQIRAEALLAAGSHVIILGDLNTAHRPIDHWDAVNLECFEEDPGRKWMDSLLSNLGCQSASHVGPFIDSYRCFQPKQEGAFTCWSAVTGARHLNYGSRLDYVLGDRTLVIDTFQASFLLPEVMGSDHCPVGAVLSVSSVPAKQCPPLCTRFLPEFAGTQLKILRFLVPLEQSPVLEQSTLQHNNQTRVQTCQNKAQVRSTRPQPSQVGSSRGQKNLKSYFQPSPSCPQASPDIELPSLPLMSALMTPKTPEEKAVAKVVKGQAKTSEAKDEKELRTSFWKSVLAGPLRTPLCGGHREPCVMRTVKKPGPNLGRRFYMCARPRGPPTDPSSRCNFFLWSRPS.

In some embodiments, the APEX2 polypeptide comprises or consists of:

(SEQ ID NO: 39)
MLRVVSWNINGIRRPLQGVANQEPSNCAAVAVGRILDELDADIVCLQETKVTRDALTEPLAIVEGYNSYFSFSRNRSGYSGVATFCKDNATPVAAEEGLSGLFATQNGDVGCYGNMDEFTQEELRALDSEGRALLTQHKIRTWEGKEKTLTLINVYCPHADPGRPERLVFKMRFYRLLQIRAEALLAAGSHVIILGDLNTAHRPIDHWDAVNLECFEEDPGRKWMDSLLSNLGCQSASHVGPFIDSYRCFQPKQEGAFTCWSAVTGARHLNYGSRLDYVLGDRTLVIDTFQASFLLPEVMGSDHCPVGAVLSVSSVPAKQCPPLCTRFLPEFAGTQLKILRFLVPLEQSP.

In some embodiments, the second RNA binding protein comprises or consists of an apurinic or apyrimidinic site lyase (APEX1) polypeptide. In some embodiments, the APEX1 polypeptide comprises or consists of:

(SEQ ID NO: 125)
PKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLS.

In some embodiments of the compositions of the disclosure, the second RNA binding protein comprises or consists of an angiogenin (ANG) polypeptide. In some embodiments, the ANG polypeptide comprises or consists of:

(SEQ ID NO: 40)
QDNSRYTHFLTQHYDAKPQGRDDRYCESIMRRRGLTSPCKDINTFIHGNKRSIKAICENKNGNPHRENLRISKSSFQVTTCKLHGGSPWPPCQYRATAGFRNVVVACENGLPVHLDQSIFRRP.

In some embodiments of the compositions of the disclosure, the second RNA binding protein comprises or consists of a heat responsive protein 12 (HRSP12) polypeptide. In some embodiments, the HRSP12 polypeptide comprises or consists of:

(SEQ ID NO: 41)
SSLIRRVISTAKAPGAIGPYSQAVLVDRTIYISGQIGMDPSSGQLVSGGVAEEAKQALKNMGEILKAAGCDFTNVVKTTVLLADINDFNTVNEIYKQYFKSNFPARAAYQVAALPKGSRIEIEAVAIQGPLTTASL.

In some embodiments of the compositions of the disclosure, the second RNA binding protein comprises or consists of a Zinc Finger CCCH-Type Containing 12A (ZC3H12A) polypeptide. In some embodiments, the ZC3H12A polypeptide comprises or consists of:

(SEQ ID NO: 42)
GGGTPKAPNLEPPLPEEEKEGSDLRPVVIDGSNVAMSHGNKEVFSCRGILLAVNWFLERGHTDITVFVPSWRKEQPRPDVPITDQHILRELEKKKILVFTPSRRVGGKRVVCYDDRFIVKLAYESDGIVVSNDTYRDLQGERQEWKRFIEERLLMYSFVNDKFMPPDDPLGRHGPSLDNFLRKKPLTLE.

In some embodiments, the ZC3H12A polypeptide comprises or consists of:

(SEQ ID NO: 43)
SGPCGEKPVLEASPTMSLWEFEDSHSRQGTPRPGQELAAEEASALELQMKVDFFRKLGYSSTEIHSVLQKLGVQADTNTVLGELVKHGTATERERQTSPDPCPQLPLVPRGGGTPKAPNLEPPLPEEEKEGSDLRPVVIDGSNVAMSHGNKEVFSCRGILLAVNWFLERGHTDITVFVPSWRKEQPRPDVPITDQHILRELEKKKILVFTPSRRVGGKRVVCYDDRFIVKLAYESDGIVVSNDTYRDLQGERQEWKRFIEERLLMYSFVNDKFMPPDDPLGRHGPSLDNFLRKKPLTLEHRKQPCPYGRKCTYGIKCRFFHPERPSCPQRSVADELRANALLSPPRAPSKDKNGRRPSPSSQSSSLLTESEQCSLDGKKLGAQASPGSRQEGLTQTYAPSGRSLAPSGGSGSSFGPTDWLPQTLDSLPYVSQDCLDSGIGSLESQMSELWGVRGGGPGEPGPPRAPYTGYSPYGSELPATAAFSAFGRAMGAGHFSVPADYPPAPPAFPPREYWSEPYPLPPPTSVLQEPPVQSPGAGRSPWGRAGSLAKEQASVYTKLCGVFPPHLVEAVMGRFPQLLDPQQLAAEILSYKSQHPSE.

In some embodiments of the compositions of the disclosure, the second RNA binding protein comprises or consists of a Reactive Intermediate Imine Deaminase A (RIDA) polypeptide. In some embodiments, the RIDA polypeptide comprises or consists of:

(SEQ ID NO: 44)
SSLIRRVISTAKAPGAIGPYSQAVLVDRTIYISGQIGMDPSSGQLVSGGVAEEAKQALKNMGEILKAAGCDFTNVVKTTVLLADINDFNTVNEIYKQYFKSNFPARAAYQVAALPKGSRIEIEAVAIQGPLTTASL.

In some embodiments of the compositions of the disclosure, the second RNA binding protein comprises or consists of a Phospholipase D Family Member 6 (PDL6) polypeptide. In some embodiments, the PDL6 polypeptide comprises or consists of:

(SEQ ID NO: 126)
EALFFPSQVTCTEALLRAPGAELAELPEGCPCGLPHGESALSRLLRALLAA

RASLDLCLFAFSSPQLGRAVQLLHQRGVRVRVVTDCDYMALNGSQIGLLRK

AGIQVRHDQDPGYMHHKFAIVDKRVLITGSLNWTTQAIQNNRENVLITEDD

EYVRLFLEEFERIWEQFNPTKYTFFPPKKSHGSCAPPVSRAGGRLLSWHRT

CGTSSESQT.

In some embodiments of the compositions of the disclosure, the second RNA binding protein comprises or consists of a mitochondrial ribonuclease P catalytic subunit (KIAA0391) polypeptide. In some embodiments, the KIAA0391 polypeptide comprises or consists of:

(SEQ ID NO: 127)
KARYKTLEPRGYSLLIRGLIHSDRWREALLLLEDIKKVITPSKKNYNDCIQ

GALLHQDVNTAWNLYQELLGHDIVPMLETLKAFFDFGKDIKDDNYSNKLLD

ILSYLRNNQLYPGESFAHSIKTWFESVPGKQWKGQFTTVRKSGQCSGCGKT

IESIQLSPEEYECLKGKIMRDVIDGGDQYRKTTPQELKRFENFIKSRPPFD

VVIDGLNVAKMFPKVRESQLLLNVVSQLAKRNLRLLVLGRKHMLRRSSQWS

RDEMEEVQKQASCFFADDISEDDPFLLYATLHSGNHCRFITRDLMRDHKAC

LPDAKTQRLFFKWQQGHQLAIVNRFPGSKLTFQRILSYDTVVQTTGDSWHI

PYDEDLVERCSCEVPTKWLCLHQKT.

In some embodiments of the compositions of the disclosure, the second RNA binding protein comprises or consists of an argonaute 2 (AGO2) polypeptide.

In some embodiments of the compositions of the disclosure, the AGO2 polypeptide comprises or consists of:

(SEQ ID NO: 128)
SVEPMFRHLKNTYAGLQLVVVILPGKTPVYAEVKRVGDTVLGMATQCVQMK

NVQRTTPQTLSNLCLKINVKLGGVNNILLPQGRPPVFQQPVIFLGADVTHP

PAGDGKKPSIAAVVGSMDAHPNRYCATVRVQQHRQEIIQDLAAMVRELLIQ

FYKSTRFKPTRIIFYRDGVSEGQFQQVLHHELLAIREACIKLEKDYQPGIT

FIVVQKRHHTRLFCTDKNERVGKSGNIPAGTTVDTKITHPTEFDFYLCSHA

GIQGTSRPSHYHVLWDDNRFSSDELQILTYQLCHTYVRCTRSVSIPAPAYY

AHLVAFRARYHLVDKEHDSAEGSHTSGQSNGRDHQALAKAVQVHQDTLRTM

YFA.

In some embodiments of the compositions of the disclosure, the second RNA binding protein comprises or consists of a mitochondrial nuclease EXOG (EXOG) polypeptide. In some embodiments, the EXOG polypeptide comprises or consists of:

(SEQ ID NO: 129)
QGAEGALTGKQPDGSAEKAVLEQFGFPLTGTEARCYTNHALSYDQAKRVPR

WVLEHISKSKIMGDADRKHCKFKPDPNIPPTFSAFNEDYVGSGWSRGHMAP

AGNNKFSSKAMAETFYLSNIVPQDFDNNSGYWNRIEMYCRELTERFEDVWV

VSGPLTLPQTRGDGKKIVSYQVIGEDNVAVPSHLYKVILARRSSVSTEPLA

LGAFVVPNEAIGFQPQLTEFQVSLQDLEKLSGLVFFPHLDRTSDIRNICSV

DTCKLLDFQEFTLYLSTRKIEGARSVLRLEKIMENLKNAEIEPDDYFMSRY

EKKLEELKAKEQSGTQIRKPS.

In some embodiments of the compositions of the disclosure, the second RNA binding protein comprises or consists of a Zinc Finger CCCH-Type Containing 12D (ZC3H12D) polypeptide. In some embodiments, the ZC3H12D polypeptide comprises or consists of:

(SEQ ID NO: 130)
EHPSKMEFFQKLGYDREDVLRVLGKLGEGALVNDVLQELIRTGSRPGALEH

PAAPRLVPRGSCGVPDSAQRGPGTALEEDFRTLASSLRPIVIDGSNVAMSH

GNKETFSCRGIKLAVDWFRDRGHTYIKVFVPSWRKDPPRADTPIREQHVLA

ELERQAVLVYTPSRKVHGKRLVCYDDRYIVKVAYEQDGVIVSNDNYRDLQS

ENPEWKWFIEQRLLMFSFVNDRFMPPDDPLGRHGPSLSNFLSRKPKPPEPS

WQHCPYGKKCTYGIKCKFYHPERPHHAQLAVADELRAKTGARPGAGAEEQR

PPRAPGGSAGARAAPREPFAHSLPPARGSPDLAALRGSFSRLAFSDDLGPL

GPPLPVPACSLTPRLGGPDWVSAGGRVPGPLSLPSPESQFSPGDLPPPPGL

QLQPRGEHRPRDLHGDLLSPRRPPDDPWARPPRSDRFPGRSVWAEPAWGDG

ATGGLSVYATEDDEGDARARARIALYSVFPRDQVDRVMAAFPELSDLARLI

LLVQRCQSAGAPLGKP.

In some embodiments of the compositions of the disclosure, the second RNA binding protein comprises or consists of an endoplasmic reticulum to nucleus signaling 2 (ERN2) polypeptide. In some embodiments, the ERN2 polypeptide comprises or consists of:

(SEQ ID NO: 131)
RQQQPQVVEKQQETPLAPADFAHISQDAQSLHSGASRRSQKRLQSPSKQAQ

PLDDPEAEQLTVVGKISFNPKDVLGRGAGGTFVFRGQFEGRAVAVKRLLRE

CFGLVRREVQLLQESDRHPNVLRYFCTERGPQFHYIALELCRASLQEYVEN

PDLDRGGLEPEVVLQQLMSGLAHLHSLHIVHRDLKPGNILITGPDSQGLGR

VVLSDFGLCKKLPAGRCSFSLHSGIPGTEGWMAPELLQLLPPDSPTSAVDI

FSAGCVFYYVLSGGSHPFGDSLYRQANILTGAPCLAHLEEEVHDKVVARDL

VGAMLSPLPQPRPSAPQVLAHPFFWSRAKQLQFFQDVSDWLEKESEQEPLV

RALEAGGCAVVRDNWHEHISMPLQTDLRKFRSYKGTSVRDLLRAVRNKKHH

YRELPVEVRQALGQVPDGFVQYFTNRFPRLLLHTHRAMRSCASESLFLPYY

PPDSEARRPCPGATGR.

In some embodiments of the compositions of the disclosure, the second RNA binding protein comprises or consists of a pelota mRNA surveillance and ribosome rescue factor (PELO) polypeptide. In some embodiments, the PELO polypeptide comprises or consists of:

(SEQ ID NO: 132)
KLVRKNIEKDNAGQVTLVPEEPEDMWHTYNLVQVGDSLRASTIRKVQTESS

TGSVGSNRVRTTLTLCVEAIDFDSQACQLRVKGTNIQENEYVKMGAYHTIE

LEPNRQFTLAKKQWDSVVLERIEQACDPAWSADVAAVVMQEGLAHICLVTP

SMTLTRAKVEVNIPRKRKGNCSQHDRALERFYEQVVQAIQRHIHFDVVKCI

LVASPGFVREQFCDYLFQQAVKTDNKLLLENRSKFLQVHASSGHKYSLKEA

LCDPTVASRLSDTKAAGEVKALDDFYKMLQHEPDRAFYGLKQVEKANEAMA

IDTLLISDELFRHQDVATRSRYVRLVDSVKENAGTVRIFSSLHVSGEQLSQ

LTGVAAILRFPVPELSDQEGDSSSEED.

In some embodiments of the compositions of the disclosure, the second RNA binding protein comprises or consists of a YBEY metallopeptidase (YBEY) polypeptide. In some embodiments, the YBEY polypeptide comprises or consists of:

(SEQ ID NO: 133)
SLVIRNLQRVIPIRRAPLRSKIEIVRRILGVQKFDLGIICVDNKNIQHINR

IYRDRNVPTDVLSFPFHEHLKAGEFPQPDFPDDYNLGDIFLGVEYIFHQCK

ENEDYNDVLTVTATHGLCHLLGFTHGTEAEWQQMFQKEKAVLDELGRRTGT

RLQPLTRGLFGGS.

In some embodiments of the compositions of the disclosure, the second RNA binding protein comprises or consists of a cleavage and polyadenylation specific factor 4 like (CPSF4L) polypeptide. In some embodiments, the CPSF4L polypeptide comprises or consists of:

(SEQ ID NO: 134)
QEVIAGLERFTFAFEKDVEMQKGTGLLPFQGMDKSASAVCNFFTKGLCEKG

KLCPFRHDRGEKMVVCKHWLRGLCKKGDHCKFLHQYDLTRMPECYFYSKFG

DCSNKECSFLHVKPAFKSQDCPWYDQGFCKDGPLCKYRHVPRIMCLNYLVG

FCPEGPKCQFAQKIREFKLLPGSKI.

In some embodiments of the compositions of the disclosure, the second RNA binding protein comprises or consists of an hCG_2002731 polypeptide. In some embodiments, the hCG_2002731 polypeptide comprises or consists of:

(SEQ ID NO: 135)
KLVRKNIEKDNAGQVTLVPEEPEDMWHTYNLVQVGDSLRASTIRKVQTESS

TGSVGSNRVRTTLTLCVEAIDFDSQACQLRVKGTNIQENEYVKMGAYHTIE

LEPNRQFTLAKKQWDSVVLERIEQACDPAWSADVAAVVMQEGLAHICLVTP

SMTLTRAKVEVNIPRKRKGNCSQHDRALERFYEQVVQAIQRHIHFDVVKCI

LVASPGFVREQFCDYLFQQAVKTDNKLLLENRSKFLQVHASSGHKYSLKEA

LCDPTVASRLSDTKAAGEVKALDDFYKMLQHEPDRAFYGLKQVEKANEAMA

IDTLLISDELFRHQDVATRSRYVRLVDSVKENAGTVRIFSSLHVSGEQLSQ

LTGVAAILRFPVPELSDQEGDSSSEED.

In some embodiments, the hCG_2002731 polypeptide comprises or consists of:

(SEQ ID NO: 136)
DPAWSADVAAVVMQEGLAHICLVTPSMTLTRAKVEVNIPRKRKGNCSQHDR

ALERFYEQVVQAIQRHIHFDVVKCILVASPGFVREQFCDYMFQQAVKTDNK

LLLENRSKFLQVHASSGHKYSLKEALCDPTVASRLSDTKAAGEVKALDDFY

KMLQHEPDRAFYGLKQVEKANEAMAIDTLLISDELFRHQDVATRSRYVRLV

DSVKENAGTVRIFSSLHVSGEQLSQLTGVAAILRFPVPELSDQEGDSSSEE

D.

In some embodiments of the compositions of the disclosure, the second RNA binding protein comprises or consists of an Excision Repair Cross-Complementation Group 1 (ERCC1) polypeptide. In some embodiments, the ERCC1 polypeptide comprises or consists of:

(SEQ ID NO: 137)
MDPGKDKEGVPQPSGPPARKKFVIPLDEDEVPPGVRGNPVLKFVRNVPWEF

GDVIPDYVLGQSTCALFLSLRYHNLHPDYIHGRLQSLGKNFALRVLLVQVD

VKDPQQALKELAKMCILADCTLILAWSPEEAGRYLETYKAYEQKPADLLME

KLEQDFVSRVTECLTTVKSVNKTDSQTLLTTFGSLEQLIAASREDLALCPG

LGPQK.

In some embodiments of the compositions of the disclosure, the second RNA binding protein comprises or consists of a ras-related C3 botulinum toxin substrate 1 isoform (RAC1) polypeptide. In some embodiments, the RAC1 polypeptide comprises or consists of:

(SEQ ID NO: 138)
KESRAKKFQRQHMDSDSSPSSSSTYCNQMMRRRNMTQGRCKPVNTFVHEPL

VDVQNVCFQEKVTCKNGQGNCYKSNSSMHITDCRLTNGSRYPNCAYRTSPK

ERHIIVACEGSPYVPVHFDASVEDST.

In some embodiments of the compositions of the disclosure, the second RNA binding protein comprises or consists of a Ribonuclease A A1 (RAA1) polypeptide. In some embodiments, the RAA1 polypeptide comprises or consists of:

(SEQ ID NO: 139)
QDNSRYTHFLTQHYDAKPQGRDDRYCESIMRRRGLTSPCKDINTFIHGNKR

SIKAICENKNGNPHRENLRISKSSFQVTTCKLHGGSPWPPCQYRATAGFRN

VVVACENGLPVHLDQSIFRRP.

In some embodiments of the compositions of the disclosure, the second RNA binding protein comprises or consists of a Ras Related Protein (RAB1) polypeptide. In some embodiments, the RAB1 polypeptide comprises or consists of:

(SEQ ID NO: 140)
GLGLVQPSYGQDGMYQRFLRQHVHPEETGGSDRYCNLMMQRRKMTLYHCKR

FNTFIHEDIWNIRSICSTTNIQCKNGKMNCHEGVVKVTDCRDTGSSRAPNC

RYRAIASTRRVVIACEGNPQVPVHFDG.

In some embodiments of the compositions of the disclosure, the second RNA binding protein comprises or consists of a DNA Replication Helicase/Nuclease 2 (DNA2) polypeptide. In some embodiments, the DNA2 polypeptide comprises or consists of:

(SEQ ID NO: 141)
XSAVDNILLKLAKFKIGFLRLGQIQKVHPAIQQFTEQEICRSKSIKSLALL

EELYNSQLIVATTCMGINHPIFSRKIFDFCIVDEASQISQPICLGPLFFSR

RFVLVGDHQQLPPLVLNREARALGMSESLFKRLEQNKSAVVQLTVQYRMNS

KIMSLSNKLTYEGKLECGSDKVANAVINLRHFKDVKLELEFYADYSDNPWL

MGVFEPNNPVCFLNTDKVPAPEQVEKGGVSNVTEAKLIVFLTSIFVKAGCS

PSDIGIIAPYRQQLKIINDLLARSIGMVEVNTVDKYQGRDKSIVLVSFVRS

NKDGTVGELLKDWRRLNVAITRAKHKLILLGCVPSLNCYPPLEKLLNHLNS

EKLISFFFCIWSHLIALL.

In some embodiments of the compositions of the disclosure, the second RNA binding protein comprises or consists of a FLJ35220 polypeptide. In some embodiments, the FLJ35220 polypeptide comprises or consists of:

(SEQ ID NO: 142)
MALRSHDRSTRPLYISVGHRMSLEAAVRLTCCCCRFRIPEPVRQADICSRE

HIRKSLGLPGPPTPRSPKAQRPVACPKGDSGESSALC.

In some embodiments of the compositions of the disclosure, the second RNA binding protein comprises or consists of a FLJ13173 polypeptide. In some embodiments, the FLJ13173 polypeptide comprises or consists of:

(SEQ ID NO: 143)
CYTNHALSYDQAKRVPRWVLEHISKSKIMGDADRKHCKFKPDPNIPPTFSA

FNEDYVGSGWSRGHMAPAGNNKFSSKAMAETFYLSNIVPQDFDNNSGYWNR

IEMYCRELTERFEDVWVVSGPLTLPQTRGDGKKIVSYQVIGEDNVAVPSHL

YKVILARRSSVSTEPLALGAFVVPNEAIGFQPQLTEFQVSLQDLEKLSGLV

FFPHLDRT.

In some embodiments of the compositions of the disclosure, the second RNA binding protein comprises or consists of Teneurin Transmembrane Protein (TENM) polypeptide. In some embodiments, the second RNA binding protein comprises or consists of Teneurin Transmembrane Protein 1 (TENM1) polypeptide. In some embodiments, the TENM1 polypeptide comprises or consists of:

(SEQ ID NO: 144)
VTVSQMTSVLNGKTRRFADIQLQHGALCFNIRYGTTVEEEKNHVLEIARQR

AVAQAWTKEQRRLQEGEEGIRAWTEGEKQQLLSTGRVQGYDGYFVLSVEQY

LELSDSANNIHFMRQSEIGRR.

In some embodiments, the second RNA binding protein comprises or consists of Teneurin Transmembrane Protein 2 (TENM2) polypeptide. In some embodiments, the TENM2 polypeptide comprises or consists of:

(SEQ ID NO: 145)
TVSQPTLLVNGKTRRFTNIEFQYSTLLLSIRYGLTPDTLDEEKARVLDQAR

QRALGTAWAKEQQKARDGREGSRLWTEGEKQQLLSTGRVQGYEGYYVLPVE

QYPELADSSSNIQFLRQNEMGKR.

In some embodiments of the compositions of the disclosure, the second RNA binding protein comprises or consists of a Ribonuclease Kappa (RNAseK) polypeptide. In some embodiments, the RNAseK polypeptide comprises or consists of:

(SEQ ID NO: 204)
MGWLRPGPRPLCPPARASWAFSHRFPSPLAPRRSPTPFFMASLLCCGPKLA

ACGIVLSAWGVIMLIMLGIFFNVHSAVLIEDVPFTEKDFENGPQNIYNLYE

QVSYNCFIAAGLYLLLGGFSFCQVRLNKRKEYMVR.

In some embodiments of the compositions of the disclosure, the second RNA binding protein comprises or consists of a transcription activator-like effector nuclease (TALEN) polypeptide or a nuclease domain thereof. In some embodiments, the TALEN polypeptide comprises or consists of:

(SEQ ID NO: 205)
```
  1 MRIGKSSGWL NESVSLEYEH VSPPTRPRDT RRRPRAAGDG GLAHLHRRLA VGYAEDTPRT

61 EARSPAPRRP LPVAPASAPP APSLVPEPPM PVSLPAVSSP RFSAGSSAAI TDPFPSLPPT

121 PVLYAMAREL EALSDATWQP AVPLPAEPPT DARRGNTVFD EASASSPVIA SACPQAFASP

181 PRAPRSARAR RARTGGDAWP APTFLSRPSS SRIGRDVFGK LVALGYSREQ IRKLKQESLS

241 EIAKYHTTLT GQGFTHADIC RISRRRQSLR VVARNYPELA AALPELTRAH IVDIARQRSG

301 DLALQALLPV ATALTAAPLR LSASQIATVA QYGERPAIQA LYRLRRKLTR APLHLTPQQV

361 VAIASNTGGK RALEAVCVQL PVLRAAPYRL STEQVVAIAS NKGGKQALEA VKAHLLDLLG

421 APYVLDTEQV VAIASHNGGK QALEAVKADL LDLRGAPYAL STEQVVAIAS HNGGKQALEA

481 VKADLLELRG APYALSTEQV VAIASHNGGK QALEAVKAHL LDLRGVPYAL STEQVVAIAS

541 HNGGKQALEA VKAQLLDLRG APYALSTAQV VAIASNGGGK QALEGIGEQL LKLRTAPYGL

601 STEQVVAIAS HDGGKQALEA VGAQLVALRA APYALSTEQV VAIASNKGGK QALEAVKAQL

661 LELRGAPYAL STAQVVAIAS HDGGNQALEA VGTQLVALRA APYALSTEQV VAIASHDGGK

721 QALEAVGAQL VALRAAPYAL NTEQVVAIAS SHGGKQALEA VRALFPDLRA APYALSTAQL

781 VAIASNPGGK QALEAVRALF RELRRAAPYAL STEQVVAIAS NHGGKQALEA VRALFRGLRA
```

-continued

```
 841 APYGLSTAQV VAIASSNGGK QALEAVWALL PVLRATPYDL NTAQIVAIAS HDGGKPALEA

901 VWAKLPVLRG APYALSTAQV VAIACISGQQ ALEAIEAHMP TLRQASHSLS PERVAAIACI

961 GGRSAVEAVR QGLPVKAIRR IRREKAPVAG PPPASLGPTP QELVAVLHFF RAHQQPRQAF

1021 VDALAAFQAT RPALLRLLSS VGVTEIEALG GTIPDATERW QRLLGRLGFR PATGAAAPSP

1081 DSLQGFAQSL ERTLGSPGMA GQSACSPHRK RPAETAIAPR SIRRSPNNAG QPSEPWPDQL

1141 AWLQRRKRTA RSHIRADSAA SVPANLHLGT RAQFTPDRLR AEPGPIMQAH TSPASVSFGS

1201 HVAFEPGLPD PGTPTSADLA SFEAEPFGVG PLDFHLDWLL QILET.
```

In some embodiments, the TALEN polypeptide comprises or consists of:

```
                                                          (SEQ ID NO: 206)
   1 mdpirsrtps parellpgpq pdrvqptadr ggappaggpl dglparrtms rtrlpsppap 61 spafsagsfs dllrqfdpsl ldtslldsmp avgtphtaaa paecdevqsg lraaddpppt 121 vrvavtaarp prakpaprrr aaqpsdaspa aqvdlrtlgy sqqqqekikp kvgstvaqhh 181 ealvghgfth ahivalsrhp aalgtvavky qdmiaalpea thedivgvgk qwsgaralea 241 lltvagelrg pplqldtgql vkiakrggvt aveavhasrn altgaplnlt paqvvaiasn 301 nggkqaletv qrllpvlcqa hgltpaqvva iashdggkqa letmqrllpv lcqahglppd 361 qvvaiasnig gkqaletvqr llpvlcqahg ltpdqvvaia shgggkqale tvqrllpvlc 421 qahgltpdqv vaiashdggk qaletvqrll pvlcqahglt pdqvvaiasn gggkqaletv 481 qrllpvlcqa hgltpdqvva iasnggkgal etvqrllpvl cqahgltpdq vvaiashdgg 541 kqaletvqrl lpvlcqthgl tpaqvvaias hdggkqalet vqqllpvlcq ahgltpdqvv 601 aiasniggkq alatvqrllp vlcqahgltp dqvvaiasng ggkqaletvq rllpvlcqah 661 gltpdqvvai asngggkqal etvqrllpvl cqahgltqvq vvaiasnigg kqaletvqrl 721 lpvlcqahgl tpaqvvaias hdggkqalet vqrllpvlcq ahgltpdqvv aiasngggkq 781 aletvqrllp vlcqahgltq eqvvaiasnn ggkqaletvq rllpvlcqah gltpdqvvai 841 asngggkqal etvqrllpvl cqahgltpaq vvaiasnigg kqaletvqrl lpvlcqdhgl 901 tlaqvvaias niggkqalet vqrllpvlcq ahgltqdqvv aiasniggkq aletvqrllp 961 vlcqdhgltp dqvvaiasni ggkqaletvq rllpvlcqdh gltldqvvai asnggkqale 1021 tvqrllpvlc qdhgltpdqv vaiasnsggk qaletvqrll pvlcqdhglt pnqvvaiasn 1081 ggkqalesiv aqlsrpdpal aaltndhlva laclggrpam davkkglpha pelirrvnrr 1141 igertshrva dyaqvvrvle ffqchshpay afdeamtqfg msrnglvqlf rrvgvtelea 1201 rggtlppasq rwdrilqasg mkrakpspts aqtpdqaslh afadslerdl dapspmhegd 1261 qtgassrkrs rsdravtgps aqhsfevrvp eqrdalhlpl swrvkrprtr igglpdpgt 1321 piaadlaass tvmwegdaap fagaaddfpa fneeelawlm ellpqsgsvg gti.
```

In some embodiments of the compositions of the disclosure, the second RNA binding protein comprises or consists a zinc finger nuclease polypeptide or a nuclease domain thereof. In some embodiments, the second RNA binding protein comprises or consists of a ZNF638 polypeptide or a nuclease domain thereof. In some embodiments, the ZNF638 polypeptide polypeptide comprises or consists of:

```
                                                          (SEQ ID NO: 207)
   1 MSRPRFNPRG DFPLQRPRAP NPSGMRPPGP FMRPGSMGLP RFYPAGRARG IPHRFAGHES

61 YQNMGPQRMN VQVTQHRTDP RLTKEKLDFH EAQQKKGKPH GSRWDDEPHI SASVAVKQSS

121 VTQVTEQSPK VQSRYTKESA SSILASFGLS NEDLEELSRY PDEQLTPENM PLILRDIRMR
```

```
-continued
 181 KMGRRLPNLP SQSRNKETLG SEAVSSNVID YGHASKYGYT EDPLEVRIYD PEIPTDEVEN

241 EFQSQQNISA SVPNPNVICN SMFPVEDVFR QMDFPGESSN NRSFFSVESG TKMSGLHISG

301 GQSVLEPIKS VNQSINQTVS QTMSQSLIPP SMNQQPFSSE LISSVSQQER IPHEPVINSS

361 NVHVGSRGSK KNYQSQADIP IRSPFGIVKA SWLPKFSHAD AQKMKRLPTP SMMNDYYAAS

421 PRIFPHLCSL CNVECSHLKD WIQHQNTSTH IESCRQLRQQ YPDWNPEILP SRRNEGNRKE

481 NETPRRRSHS PSPRRSRRSS SSHRFRRSRS PMHYMYRPRS RSPRICHRFI SRYRSRSRSR

541 SPYRIRNPFR GSPKCFRSVS PERMSRRSVR SSDRKKALED VVQRSGHGTE FNKQKHLEAA

601 DKGHSPAQKP KTSSGTKPSV KPTSATKSDS NLGGHSIRCK SKNLEDDTLS ECKQVSDKAV

661 SLQRKLRKEQ SLHYGSVLLI TELPEDGCTE EDVRKLFQPF GKVNDVLIVP YRKEAYLEME

721 FKEAITAIMK YIETTPLTIK GKSVKICVPG KKKAQNKEVK KKTLESKKVS ASTLKRDADA

781 SKAVEIVTST SAAKTGQAKA SVAKVNKSTG KSASSVKSVV TVAVKGNKAS IKTAKSGGKK

841 SLEAKKTGNV KNKDSNKPVT IPENSEIKTS IEVKATENCA KEAISDAALE ATENEPLNKE

901 TEEMCVMLVS NLPNKGYSVE EVYDLAKPFG GLKDILILSS HKKAYIEINR KAAESMVKFY

961 TCFPVLMDGN QLSISMAPEN MNIKDEEAIF ITLVKENDPE ANIDTIYDRF VHLDNLPEDG

1021 LQCVLCVGLQ FGKVDHHVFI SNRNKAILQL DSPESAQSMY SFLKQNPQNI GDHMLTCSLS

1081 PKIDLPEVQI EHDPELEKES PGLKNSPIDE SEVQTATDSP SVKPNELEEE STPSIQTETL

1141 VQQEEPCEEE AEKATCDSDF AVETLELETQ GEEVKEEIPL VASASVSIEQ FTENAEECAL

1201 NQQMFNSDLE KKGAEIINPK TALLPSDSVF AEERNLKGIL EESPSEAEDF ISGITQTMVE

1261 AVAEVEKNET VSEILPSTCI VTLVPGIPTG DEKTVDKKNI SEKKGNMDEK EEKEFNTKET

1321 RMDLQIGTEK AEKNEGRMDA EKVEKMAAMK EKPAENTLFK AYPNKGVGQA NKPDETSKTS

1381 ILAVSDVSSS KPSIKAVIVS SPKAKATVSK TENQKSFPKS VPRDQINAEK KLSAKEFGLL

1441 KPTSARSGLA ESSSKFKPTQ SSLTRGGSGR ISALQGKLSK LDYRDITKQS QETEARPSIM

1501 KRDDSNNKTL AEQNTKNPKS TTGRSSKSKE EPLFPFNLDE FVTVDEVIEE VNPSQAKQNP

1561 LKGKRKETLK NVPFSELNLK KKKGKTSTPR GVEGELSFVT LDEIGEEEDA AAHLAQALVT

1621 VDEVIDEEEL NMEEMVKNSN SLFTLDELID QDDCISHSEP KDVTVLSVAE EQDLLKQERL

1681 VTVDEIGEVE ELPLNESADI TFATLNTKGN EGDTVRDSIG FISSQVPEDP STLVTVDEIQ

1741 DDSSDLHLVT LDEVTEEDED SLADFNNLKE ELNFVTVDEV GEEEDGDNDL KVELAQSKND

1801 HPTDKKGNRK KRAVDTKKTK LESLSQVGPV NENVMEEDLK TMIERHLTAK TPTKRVRIGK

1861 TLPSEKAVVT EPAKGEEAFQ MSEVDEESGL KDSEPERKRK KTEDSSSGKS VASDVPEELD

1921 FLVPKAGFFC PICSLFYSGE KAMTNHCKST RHKQNTEKFM AKQRKEKEQN EAEERSSR.
```

Figure 9:
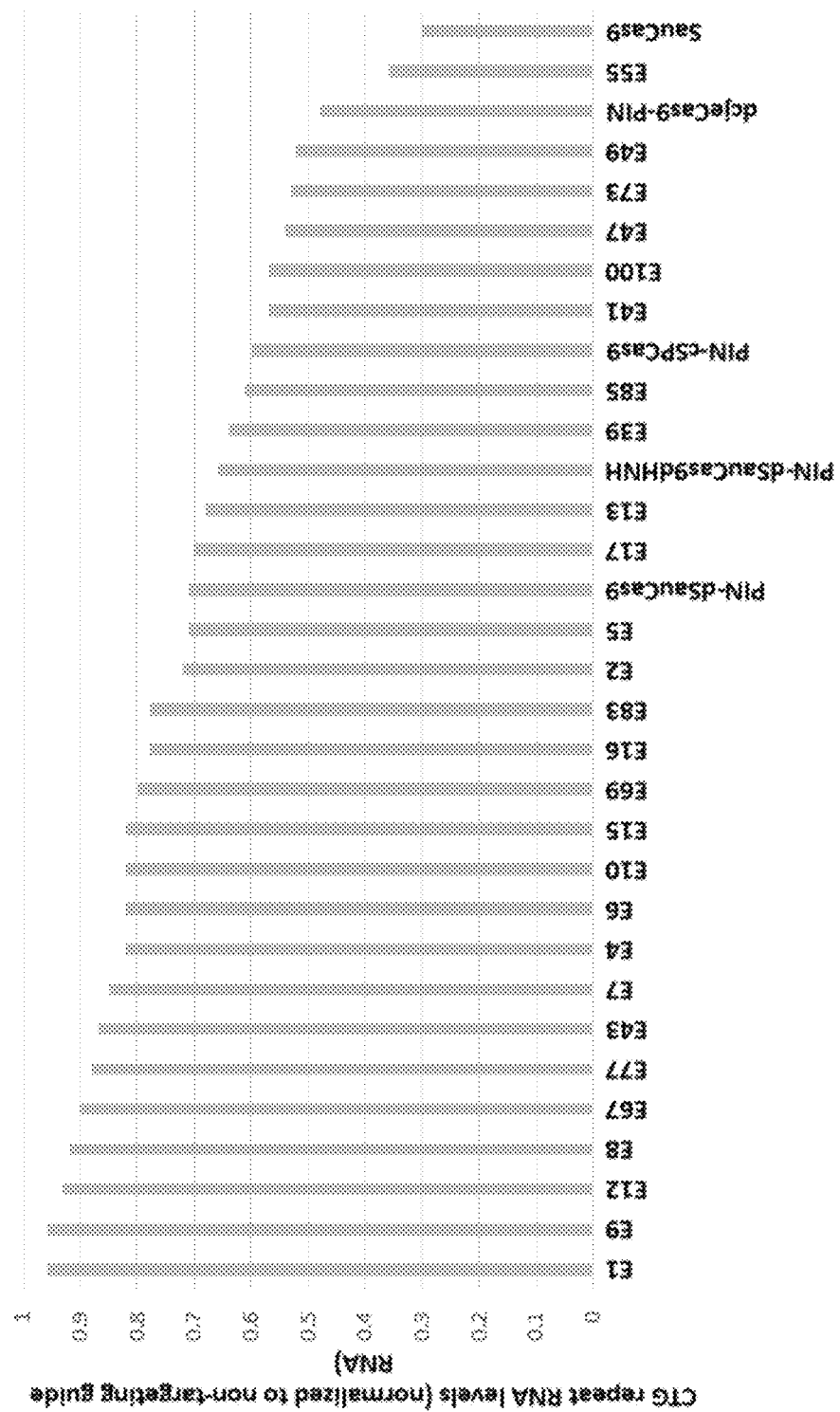
FIG. 9 is a graph depicting the cleavage efficiencies of a variety of exemplary fusion proteins (SpyCas9 fused to the annotated endonuclease).

In some embodiments of the compositions of the disclosure, the second RNA binding protein comprises or consists of a PIN domain derived from the human SMG6 protein, also commonly known as telomerase-binding protein EST1A isoform 3, NCBI Reference Sequence: NP_001243756.1. In some embodiments, the PIN from hSMG6 is used herein in the form of a Cas fusion protein and as an internal control, for example, and without limitation, see FIG. 9, which shows PIN-dSauCas9, PIN-dSauCas9dHNH, PIN-dSPCas9, and dcjeCas9-PIN.

In some embodiments of the compositions of the disclosure, the composition further comprises (a) a sequence comprising a gRNA that specifically binds within an RNA molecule and (b) a sequence encoding a nuclease. In some embodiments, a nuclease comprises a sequence isolated or derived from a CRISPR/Cas protein. In some embodiments, the CRISPR/Cas protein is isolated or derived from any one of a type I, a type IA, a type IB, a type IC, a type ID, a type IE, a type IF, a type IU, a type III, a type IIIA, a type IIIB, a type IIIC, a type IIID, a type IV, a type IVA, a type IVB, a type II, a type IIA, a type BB, a type ITC, a type V, or a type VI CRISPR/Cas protein. In some embodiments, a nuclease comprises a sequence isolated or derived from a TALEN or a nuclease domain thereof. In some embodiments, a nuclease comprises a sequence isolated or derived from a zinc finger nuclease or a nuclease domain thereof.

Fusion Proteins

In some embodiments of the compositions and methods of the disclosure, the composition comprises a sequence encoding a target RNA-binding fusion protein comprising (a) a sequence encoding a first RNA-binding polypeptide or portion thereof; and (b) a sequence encoding a second RNA-binding polypeptide, wherein the first RNA-biding polypeptide binds a target RNA, and wherein the second RNA-binding polypeptide comprises RNA-nuclease activity.

In some embodiments, a target RNA-binding fusion protein is an RNA-guided target RNA-binding fusion protein. RNA-guided target RNA-binding fusion proteins comprise at least one RNA-binding polypeptide which corresponds to a gRNA which guides the RNA-binding polypeptide to target RNA. RNA-guided target RNA-binding fusion proteins include without limitation, RNA-binding polypeptides which are CRISPR/Cas-based RNA-binding polypeptides or portions thereof.

In some embodiments, a target RNA-binding fusion protein is not an RNA-guided target RNA-binding fusion protein and as such comprises at least one RNA-binding polypeptide which is capable of binding a target RNA without a corresponding gRNA sequence. Such non-guided RNA-binding polypeptides include, without limitation, at least one RNA-binding protein or RNA-binding portion thereof which is a PUF (Pumilio and FBF homology family). This type RNA-binding polypeptide can be used in place of a gRNA-guided RNA binding protein such as CRISPR/Cas. The unique RNA recognition mode of PUF proteins (named for *Drosophila Pumilio* and *C. elegans* fem-3 binding factor) that are involved in mediating mRNA stability and translation are well known in the art. The PUF domain of human Pumilio1, also known in the art, binds tightly to cognate RNA sequences and its specificity can be modified. It contains eight PUF repeats that recognize eight consecutive RNA bases with each repeat recognizing a single base. Since two amino acid side chains in each repeat recognize the Watson-Crick edge of the corresponding base and determine the specificity of that repeat, a PUF domain can be designed to specifically bind most 8-nt RNA. Wang et al., *Nat Methods*. 2009; 6(11): 825-830. See also WO2012/068627 which is incorporated by reference herein in its entirety.

In some embodiments of the non-guided RNA-binding fusion proteins of the disclosure, the fusion protein comprises at least one RNA-binding protein or RNA-binding portion thereof which is a PUMBY (Pumilio-based assembly) protein. RNA-binding protein PumHD (Pumilio homology domain, a member of the PUF family), which has been widely used in native and modified form for targeting RNA, has been engineered to yield a set of four canonical protein modules, each of which targets one RNA base. These modules (i.e., Pumby, for Pumilio-based assembly) can be concatenated in chains of varying composition and length, to bind desired target RNAs. The specificity of such Pumby-RNA interactions is high, with undetectable binding of a Pumby chain to RNA sequences that bear three or more mismatches from the target sequence. Katarzyna et al., *PNAS*, 2016; 113(19): E2579-E2588. See also US 2016/0238593 which is incorporated by reference herein in its entirety.

In some embodiments of the compositions of the disclosure, the first RNA binding protein comprises a Pumilio and FBF (PUF) protein. In some embodiments, the first RNA binding protein comprises a Pumilio-based assembly (PUMBY) protein. In some embodiments, a PUF1 protein of the disclosure comprises or consists of the amino acid sequence of (SEQ ID NO: 209)

```
MDKSKQMNIN NLSNIPEVID PGITIPIYEE EYENNGESNS QLQQQPQKLG SYRSRAGKFS    60

NTLSNLLPSI SAKLHHSKKN SHGKNGAEFS SSNNSSQSTV ASKTPRASPS RSKMMESSID   120

GVTMDRPGSL TPPQDMEKLV HFPDSSNNFL IPAPRGSSDS FNLPHQISRT RNNTMSSQIT   180

SISSIAPKPR TSSGIWSSNA SANDPMQQHL LQQLQPTTSN NTTNSNTLND YSTKTAYFDN   240

MVSTSGSQMA DNKMNTNNLA IPNSVWSNTR QRSQSNASSI YTDAPLYEQP ARASISSHYT   300

IPTQESPLIA DEIDPQSINW VTMDPTVPSI NQISNLLPTN TISISNVFPL QHQQPQLNNA   360

INLTSTSLAT LCSKYGEVIS ARTLRNLNMA LVEFSSVESA VKALDSLQGK EVSMIGAPSK   420

ISFAKILPMH QQPPQFLLNS QGLPLGLENN NLQPQPLLQE QLFNGAVTFQ QQGNVSIPVF   480

NQQSQQSQHQ NHSSGSAGFS NVLHGYNNNN SMHGNNNNSA NEKEQCPFPL PPPNVNEKED   540

LLREIIELFE ANSDEYQINS LIKKSLNHKG TSDTQNFGPL PEPLSGREFD PPKLRELRKS   600

IDSNAFSDLE IEQLAIAMLD ELPELSSDYL GNTIVQKLFE HSSDIIKDIM LRKTSKYLTS   660

MGVHKNGTWA CQKMITMAHT PRQIMQVTQG VKDYCTPLIN DQFGNYVIQC VLKFGFPWNQ   720

FIFESIIANF WVIVQNRYGA RAVRACLEAH DIVTPEQSIV LSAMIVTYAE YLSTNSNGAL   780

LVTWFLDTSV LPNRHSILAP RLTKRIVELC GHRLASLTIL KVLNYRGDDN ARKIILDSLF   840

GNVNAHDSSP PKELTKLLCE TNYGPTFVHK VLAMPLLEDD LRAHIIKQVR KVLTDSTQIQ   900

PSRRLLEEVG LASPSSTHNK TKQQQQQHHN SSISHMFATP DTSGQHMRGL SVSSVKSGGS   960

KHTTMNTTTT NGSSASTLSP GQPLNANSNS SMGYFSYPGV FPVSGFSGNA SNGYAMNNDD  1020

LSSQFDMLNF NNGTRLSLPQ LSLTNHNNTT MELVNNVGSS QPHTNNNNNN NNTNYNDDNT  1080

VFETLTLHSA N.                                                      1091
```

In some embodiments, a PUF3 protein of the disclosure comprises or consists of the amino acid sequence of

```
  1 MEMNMDMDMD MELASIVSSL SALSHSNNNG
GQAAAAGIVN GGAAGSQQIG GFRRSSFTTA
 61 NEVDSEILLL HGSSESSPIF KKTALSVGTA
PPFSTNSKKF FGNGGNYYQY RSTDTASLSS
121 ASYNNYHTHH TAANLGKNNK VNHLLGQYSA
SIAGPVYYNG NDNNNSGGEG FFEKFGKSLI
181 DGTRELESQD RPDAVNTQSQ FISKSVSNAS
LDTQNTFEQN VESDKNFNKL NRNTTNSGSL
241 YHSSSNSGSS ASLESENAHY PKRNIWNVAN
TPVFRPSNNP AAVGATNVAL PNQQDGPANN
301 NFPPYMNGFP PNQFHQGPHY QNFPNYLIGS
PSNFISQMIS VQIPANEDTE DSNGKKKKKA
361 NRPSSVSSPS SPPNNSPFPF AYPNPMMFMP
PPPLSAPQQQ QQQQQQQQQE DQQQQQQQEN
421 PYIYYPTPNP IPVKMPKDEK TFKKRNNKNH
PANNSNNANK QANPYLENSI PTKNTSKKNA
481 SSKSNESTAN NHKSHSHSHP HSQSLQQQQQ
TYHRSPLLEQ LRNSSSDKNS NSNMSLKDIF
541 GHSLEFCKDQ HGSRFIQREL ATSPASEKEV
IFNEIRDDAI ELSNDVFGNY VIQKFFEFGS
601 KIQKNTLVDQ FKGNMKQLSL QMYACRVIQK
ALEYIDSNQR IELVLELSDS VLQMIKDQNG
661 NHVIQKAIET IPIEKLPFIL SSLTGHIYHL STH-
SYGCRVI QRLLEFGSSE DQESILNELK
721 DFIPYLIQDQ YGNYVIQYVL QQDQFTNKEM
VDIKQEIIET VANNVVEYSK HKFASNVVEK
781 SILYGSKNQK DLIISKILPR DKNHALNLED
DSPMILMIKD QFANYVIQKL VNVSEGEGKK
841 LIVIAIRAYL DKLNKSNSLG NRHLASVEKL
AALVENAEV (SEQ ID NO: 210). In some embodiments,
a PUF4 protein of the disclosure comprises or consists of the amino acid sequence of
```

121 VRSTRLLPAW AVDNSGNIRD DLTLQDVVSN GSLIDFAMDR TGVKFLERHF PEDHDNEMHF
181 VLFDKLTEQG AVFTSLCRSA AGNFIIQKFV EHATLDEQER LVRKMCDNGL IEMCLDKFAC
241 RVVQMSIQKF DVSIAMKLVE KISSLDFLPL CTDQCAIHVL QKVVKLLPIS AWSFFVKFLC
301 RDDNLMTVCQ DKYGCRLVQQ TIDKLSDNPK LHCFNTRLQL LHGLMTSVAR NCFRLSSNEF
361 ANYVVQYVIK SSGVMEMYRD TIIEKCLLRN ILSMSQDKYA SHVVEGAFLF APPLLLSEMM
421 DEIFDGYVKD QETNRDALDI LLFHQYGNYV VQQMISICIS ALLGKEERKM VASEMRLYAK
481 WFDRIKNRVN RHSGRLERFS SGKKIIESLQ KLNVPMTMTN EPMPYWAMPT PLMDISAHFM
541 NKLNFQKNSV FDE (SEQ ID NO: 212). In some embodiments, aPUF6 protein of the disclosure comprises or consists of the amino acid sequence of

```
  1 MTPNRRSTDS YNMLGASFDF DPDFSLLSNK
THKNKNPKPP VKLLPYRHGS NTTSSDLDNY
 61 IFNSGSGSSD DETPPPAAPI FISLEEVLLN GLLID-
FAIDP SGVKFLEANY PLDSEDQIRK
121 AVFEKLTEST TLFVGLCHSR NGNFIVQKLV
ELATPAEQRE LLRQMIDGGL LVMCKDKFAC
181 RVVQLALQKF DHSNVFQLIQ ELSTFDLAAM
CTDQISIHVI QRVVKQLPVD MWTFFVHFLS
241 SGDSLMAVCQ DKYGCRLVQQ VIDRLAENPK
LPCFKFRIQL LHSLMTCIVR NCYRLSSNEF
301 ANYVIQYVIK SSGIMEMYRD TIIDKCLLRN
LLSMSQDKYA SHVIEGAFLF APPALLHEMM
361 EEIFSGYVKD VELNRDALDI LLFHQYGNYV
VQQMISICTA ALIGKEERQL PPAILLLYSG
421 WYEKMKQRVL QHASRLERFS SGKKIIDSVM
RHGVPTAAAI NAQAAPSLME LTAQFDAMFP
```

```
                                                         (SEQ ID NO: 211)
  1 MSTKGLKEEI DDVPSVDPVV SETVNSALEQ LQLDDPEENA TSNAFANKVS QDSQFANGPP

61 SQMFPHPQMM GGMGFMPYSQ MMQVPHNPCP FFPPPDFNDP TAPLSSSPLN AGGPPMLFKN

121 DSLPFQMLSS GAAVATQGGQ NLNPLINDNS MKVLPIASAD PLWTHSNVPG SASVAIEETT

181 ATLQESLPSK GRESNNKASS FRRQTFHALS PTDLINAANN VTLSKDFQSD MQNFSKAKKP

241 SVGANNTAKT RTQSISFDNT PSSTSFIPPT NSVSEKLSDF KIETSKEDLI NKTAPAKKES

301 PTTYGAAYPY GGPLLQPNPI MPGHPHNISS PIYGIRSPFP NSYEMGAQFQ PFSPILNPTS

361 HSLNANSPIP LTQSPIHLAP VLNPSSNSVA FSDMKNDGGK PTTDNDKAGP NVRMDLINPN

421 LGPSMQPFHI LPPQQNTPPP PWLYSTPPPF NAMVPPHLLA QNHMPLMNSA NNKHHGRNNN

481 SMSSHNDNDN IGNSNYNNKD TGRSNVGKMK NMKNSYHGYY NNNNNNNNNN NNNNNSNATN

541 SNSAEKQRKI EESSRFADAV LDQYIGSIHS LCKDQHGCRF LQKQLDILGS KAADAIFEET

601 KDYTVELMTD SFGNYLIQKL LEEVTTEQRI VLTKISSPHF VEISLNPHGT RALQKLIECI

661 KTDEEAQIVV DSLRPYTVQL SKDLNGNHVI QKCLQRLKPE NFQFIFDAIS DSCIDIATHR

721 HGCCVLQRCL DHGTTEQCDN LCDKLLALVD KLTLDPFGNY VVQYIITKEA EKNKYDYTHK

781 IVHLLKPRAI ELSIHKFGSN VIEKILKTAI VSEPMILEIL NNGGETGIQS LLNDSYGNYV

841 LQTALDISHK QNDYLYKRLS EIVAPLLVGP IRNTPHGKRI IGMLHLDS.
```

In some embodiments, a PUF5 protein of the disclosure comprises or consists of the amino acid sequence of

```
  1 MSDSTGRINS KASDSSSISD HQTADLSIFN
GSFDGGAFSS SNIPLFNFMG TGNQRFQYSP
 61 HPFAKSSDPC RLAALTPSTP KGPLNLTPAD
FGLADFSVGN ESFADFTANN TSFVGNVQSN
```

481 SFLAR (SEQ ID NO: 213). In some embodiments, a PUF7 protein of the disclosure comprises or consists of the amino acid sequence of

```
  1 MTPNRRSTDS YNMLGASFDF DPDFSLLSNK
THKNKNPKPP VKLLPYRHGS NTTSSDSDSY
```

```
 61 IFNSGSGSSD AETPAPVAPI FISLEDVLLN
GQLIDFAIDP SGVKFLEANY PLDSEDQIRK
121 AVFEKFTEST TLFVGLCHSR NGNFIVQKLV
ELATPAEQRE LLRQMIDGGL LAMCKDKFAC
181 RVVQLALQKF DHSNVFQLIQ ELSTFDLAAM
CTDQISIHVI QRVVKQLPVD MWTFFVHFLS
241 SGDSLMAVCQ DKYGCRLVQQ VIDRLAENPK
LPCFKFRIQL LHSLMTCIVR NCYRLSSNEF
301 ANYVIQYVIK SSGIMEMYRD TIIDKCLLRN
LLSMSQDKYA SHVIEGAFLF APPALLHEMM
361 EEIFSGYVKD VESNRDALDI LLFHQYGNYV
VQQMISICTA ALIGKEEREL PPAILLLYSG
421 WYEKMKQRVL QHASRLERFS SGKKIIDSVM
RHGVPTAAAV NAQAAPSLME LTAQFDAMFP
481 SFLAR (SEQ ID NO: 214).
```

In some embodiments, a PUF8 protein of the disclosure comprises or consists of the amino acid sequence of

```
 1 MSRPISIGNT CTFDPSASPI ESLGRSIGAQ KIVDS-
VCGSP IRSYGRHIST NPKNERLPDT
 61 PEFQFATYMH QGGYVIGQNT LHMFGTPPSC
YCAQENIPIS SNVGHVLSTI NNNYMNHQYN
121 GSNMFSNQMT QMLQAQAYND LQMHQAH-
SQS IRVPVQPSAT GIFSNPYREP TTTDDLLTRY
181 RANPAMMKNL KLSDIRGALL KFAKDQVGSR
FIQQELASSK DRFEKDSIFD EVVSNADELV
241 DDIFGNYVVQ KFFEYGEERH WARLVDAIID
RVPEYAFQMY ACRVLQKALE KINEPLQIKI
301 LSQIRHVIHR CMKDQNGNHV VQKAIEKVSP
QYVQFIVDTL LESSNTIYEM SVDPYGCRW
361 QRCLEHCSPS QTKPVIGQIH KRFDEIANNQ
YGNYVVQHVI EHGSEEDRMV IVTPRVSNNLF
421 EFATHKYSSN VIEKCLEQGA VYHKSMIVGA
ACHHQEGSVP IVVQMMKDQY ANYVVQKMFD
481 QVTSEQRREL ILTVRPHIPV LRQFPHGKHI
LAKLEKYFQK PAVMSYPYQD MQGSH (SEQ ID NO: 215).
```

In some embodiments, a PUF9 protein of the disclosure comprises or consists of the amino acid sequence of

```
                                                    (SEQ ID NO: 216)
  1 MADPNWAYAP PTNYYADHSI AKPIMISGGH PSQDQGHSPK SESFGQSVTT AFNGMVDNLV

61 GSPSSSVQQR NYFTTTPFPI SRSPNDRNDD KIMGNGSYGV PIPIPQDGVP QGTPDFQMTP

121 FLQQGGHLIG GSPNGPVQVS GNWYSGGAGI FSTMQQADPS NGMPGMAAEF VNNENGMPGP

181 NGMHQQAMIS GSPPFPYQNM MNLTTSFGAM GLGPQQIQQR DPQMFQQPIL HEPIQGMAQN

241 GFGQQVFFTQ MQNQQHPQGQ AQQQLQQLAQ QHQQQQNSQQ FFGQGPNGMG NGGVMNDWSQ

301 RSFGMPQQQA QQNGLPPNFS QNPPRRRGPE DPNGQTPKTL QDIKNNVIEF AKDQHGSRFI

361 QQKLERASLR DKAAIFTPVL ENAEELMTDV FGNYVIQKFF EFGNNEQRNQ LVGTIRGNVM

421 KLALQMYGCR VIQKALEYVE EKYQHEILGE MEGQVLKCVK DQNGNHVIQK VIERVEPERL

481 QFIIDAFTKN NSDNVYTLSV HPYGCRVIQR VLEYCNEEQK QPVLDALQIH LKQLVLDQYG

541 NYVIQHVIEH GSPSDKEQIV QDVISDDLLK FAQHKFASNV IEKCLTFGGH AERNLIIDKV

601 CGDPNDPSPP LLQMMKDPFA NYVVQKMLDV ADPQHRKKIT LTIKPHIATL RKYNFGKHIL

661 LKLEKYFAKQ APANSSNSSS NDQIYEHSPF DIPLGADFSN HPF.
```

In some embodiments of the compositions of the disclosure, at least one of the RNA-binding proteins or RNA-binding portions thereof is a PPR protein. PPR proteins (proteins with pentatricopeptide repeat (PPR) motifs derived from plants) are nuclear-encoded and exclusively controlled at the RNA level organelles (chloroplasts and mitochondria), cutting, translation, splicing, RNA editing, genes specifically acting on RNA stability. PPR proteins are typically a motif of 35 amino acids and have a structure in which a PPR motif is about 10 contiguous amino acids. The combination of PPR motifs can be used for sequence-selective binding to RNA. PPR proteins are often comprised of PPR motifs of about 10 repeat domains. PPR domains or RNA-binding domains may be configured to be catalytically inactive. WO 2013/058404 incorporated herein by reference in its entirety.

In some embodiments, the fusion protein disclosed herein comprises a linker between the at least two RNA-binding polypeptides. In some embodiments, the linker is a peptide linker. In some embodiments, the peptide linker comprises one or more repeats of the tri-peptide GGS. In other embodiments, the linker is a non-peptide linker. In some embodiments, the non-peptide linker comprises polyethylene glycol (PEG), polypropylene glycol (PPG), co-poly(ethylene/propylene) glycol, polyoxyethylene (POE), polyurethane, polyphosphazene, polysaccharides, dextran, polyvinyl alcohol, polyvinylpyrrolidones, polyvinyl ethyl ether, polyacryl amide, polyacrylate, polycyanoacrylates, lipid polymers, chitins, hyaluronic acid, heparin, or an alkyl linker.

In some embodiments, the at least one RNA-binding protein does not require multimerization for RNA-binding activity. In some embodiments, the at least one RNA-binding protein is not a monomer of a multimer complex. In some embodiments, a multimer protein complex does not comprise the RNA binding protein. In some embodiments, the at least one of RNA-binding protein selectively binds to a target sequence within the RNA molecule. In some embodiments, the at least one RNA-binding protein does not comprise an affinity for a second sequence within the RNA molecule. In some embodiments, the at least one RNA-binding protein does not comprise a high affinity for or selectively bind a second sequence within the RNA molecule. In some embodiments, the at least one RNA-binding protein comprises between 2 and 1300 amino acids, inclusive of the endpoints.

In some embodiments, the at least one RNA-binding protein of the fusion proteins disclosed herein further comprises a sequence encoding a nuclear localization signal (NLS). In some embodiments, a nuclear localization signal (NLS) is positioned 3' to the RNA binding protein. In some embodiments, the at least one RNA-binding protein comprises an NLS at a C-terminus of the protein. In some embodiments, the at least one RNA-binding protein further comprises a first sequence encoding a first NLS and a second sequence encoding a second NLS. In some embodiments, the first NLS or the second NLS is positioned 3' to the RNA-binding protein. In some embodiments, the at least one RNA-binding protein comprises the first NLS or the second NLS at a C-terminus of the protein. In some embodiments, the at least one RNA-binding protein further comprises an NES (nuclear export signal) or other peptide tag or secretory signal.

In some embodiments, a fusion protein disclosed herein comprises the at least one RNA-binding protein as a first RNA-binding protein together with a second RNA-binding protein comprising or consisting of a nuclease domain.

In some embodiments, the second RNA-binding polypeptide is operably configured to the first RNA-binding polypeptide at the C-terminus of the first RNA-binding polypeptide. In some embodiments, the second RNA-binding polypeptide is operably configured to the first RNA-binding polypeptide at the N-terminus of the first RNA-binding polypeptide. For example, one such exemplary fusion protein is E99 which is configured so that RNAse1(R39D, N67D, N88A, G89D, R19D, H119N, K41R) is located at the N-terminus of SpyCas9 whereas another exemplary fusion protein, E100, is configured so that RNAse1(R39D, N67D, N88A, G89D, R19D, H119N, K41R) is located at the C-terminus of SpyCas9. See FIG. 6.

Vectors

In some embodiments of the compositions and methods of the disclosure, a vector comprises a guide RNA of the disclosure. In some embodiments, the vector comprises at least one guide RNA of the disclosure. In some embodiments, the vector comprises one or more guide RNA(s) of the disclosure. In some embodiments, the vector comprises two or more guide RNAs of the disclosure. In some embodiments, the vector further comprises a fusion protein of the disclosure. In some embodiments, the fusion protein comprises a first RNA binding protein and a second RNA binding protein.

In some embodiments of the compositions and methods of the disclosure, a first vector comprises a guide RNA of the disclosure and a second vector comprises a fusion protein of the disclosure. In some embodiments, the first vector comprises at least one guide RNA of the disclosure. In some embodiments, the first vector comprises one or more guide RNA(s) of the disclosure. In some embodiments, the first vector comprises two or more guide RNA(s) of the disclosure. In some embodiments, the fusion protein comprises a first RNA binding protein and a second RNA binding protein. In some embodiments, the first vector and the second vector are identical. In some embodiments, the first vector and the second vector are not identical.

In some embodiments of the compositions and methods of the disclosure, the vector is or comprises a component of a "2-component RNA targeting system" comprising (a) nucleic acid sequence encoding a RNA-targeted fusion protein of the disclosure; and (b) a single guide RNA (sgRNA) sequence comprising: on its 5' end, an RNA sequence (or spacer sequence) that hybridizes to or binds to a target RNA sequence; and on its 3' end, an RNA sequence (or scaffold sequence) capable of binding to or associating with the CRISPR/Cas protein of the fusion protein; and wherein the 2-component RNA targeting system recognizes and alters the target RNA in a cell in the absence of a PAMmer. In some embodiments, the sequences of the 2-component system are in a single vector. In some embodiments, the spacer sequence of the 2-component system targets a repeat sequence selected from the group consisting of CUG, CCUG, CAG, and GGGGCC.

In some embodiments of the compositions and methods of the disclosure, a vector of the disclosure is a viral vector. In some embodiments, the viral vector comprises a sequence isolated or derived from a retrovirus. In some embodiments, the viral vector comprises a sequence isolated or derived from a lentivirus. In some embodiments, the viral vector comprises a sequence isolated or derived from an adenovirus. In some embodiments, the viral vector comprises a sequence isolated or derived from an adeno-associated virus (AAV). In some embodiments, the viral vector is replication incompetent. In some embodiments, the viral vector is isolated or recombinant. In some embodiments, the viral vector is self-complementary.

In some embodiments of the compositions and methods of the disclosure, the viral vector comprises a sequence isolated or derived from an adeno-associated virus (AAV). In some embodiments, the viral vector comprises an inverted terminal repeat sequence or a capsid sequence that is isolated or derived from an AAV of serotype AAV1, AAV2, AAV3, AAV4, AAV5, AAV6, AAV7, AAV8, AAV9, AAV10, AAV11 or AAV12. In some embodiments, the viral vector is replication incompetent. In some embodiments, the viral vector is isolated or recombinant (rAAV). In some embodiments, the viral vector is self-complementary (scAAV).

In some embodiments of the compositions and methods of the disclosure, a vector of the disclosure is a non-viral vector. In some embodiments, the vector comprises or consists of a nanoparticle, a micelle, a liposome or lipoplex, a polymersome, a polyplex or a dendrimer. In some embodiments, the vector is an expression vector or recombinant expression system. As used herein, the term "recombinant expression system" refers to a genetic construct for the expression of certain genetic material formed by recombination.

In some embodiments of the compositions and methods of the disclosure, an expression vector, viral vector or non-viral vector provided herein, includes without limitation, an expression control element. An "expression control element" as used herein refers to any sequence that regulates the expression of a coding sequence, such as a gene. Exemplary expression control elements include but are not limited to promoters, enhancers, microRNAs, post-transcriptional regulatory elements, polyadenylation signal sequences, and introns. Expression control elements may be constitutive, inducible, repressible, or tissue-specific, for example. A "promoter" is a control sequence that is a region of a polynucleotide sequence at which initiation and rate of transcription are controlled. It may contain genetic elements at which regulatory proteins and molecules may bind such as RNA polymerase and other transcription factors. In some embodiments, expression control by a promoter is tissue-specific. Non-limiting exemplary promoters include CMV, CBA, CAG, Cbh, EF-1a, PGK, UBC, GUSB, UCOE, hAAT, TBG, Desmin, MCK, C5-12, NSE, Synapsin, PDGF, MecP2, CaMKII, mGluR2, NFL, NFH, nβ2, PPE, ENK, EAAT2, GFAP, MBP, and U6 promoters. An "enhancer" is a region of DNA that can be bound by activating proteins to increase the likelihood or frequency of transcription. Non-limiting exemplary enhancers and posttranscriptional regulatory elements include the CMV enhancer and WPRE.

In some embodiments of the compositions and methods of the disclosure, an expression vector, viral vector or non-viral vector provided herein, includes without limitation, vector elements such as an IRES or 2A peptide sites for configuration of "multicistronic" or "polycistronic" or "bicistronic"

or "tricistronic" constructs, i.e., having double or triple or multiple coding areas or exons, and as such will have the capability to express from mRNA two or more proteins from a single construct. Multicistronic vectors simultaneously express two or more separate proteins from the same mRNA. The two strategies most widely used for constructing multicistronic configurations are through the use of an IRES or a 2A self-cleaving site. An "IRES" refers to an internal ribosome entry site or portion thereof of viral, prokaryotic, or eukaryotic origin which are used within polycistronic vector constructs. In some embodiments, an IRES is an RNA element that allows for translation initiation in a cap-independent manner. The term "self-cleaving peptides" or "sequences encoding self-cleaving peptides" or "2A self-cleaving site" refer to linking sequences which are used within vector constructs to incorporate sites to promote ribosomal skipping and thus to generate two polypeptides from a single promoter, such self-cleaving peptides include without limitation, T2A, and P2A peptides or sequences encoding the self-cleaving peptides.

In some embodiments, the vector is a viral vector. In some embodiments, the vector is an adenoviral vector, an adeno-associated viral (AAV) vector, or a lentiviral vector. In some embodiments, the vector is a retroviral vector, an adenoviral/retroviral chimera vector, a herpes simplex viral I or II vector, a parvoviral vector, a reticuloendotheliosis viral vector, a polioviral vector, a papillomaviral vector, a vaccinia viral vector, or any hybrid or chimeric vector incorporating favorable aspects of two or more viral vectors. In some embodiments, the vector further comprises one or more expression control elements operably linked to the polynucleotide. In some embodiments, the vector further comprises one or more selectable markers. In some embodiments, the AAV vector has low toxicity. In some embodiments, the AAV vector does not incorporate into the host genome, thereby having a low probability of causing insertional mutagenesis. In some embodiments, the AAV vector can encode a range of total polynucleotides from 4.5 kb to 4.75 kb. In some embodiments, exemplary AAV vectors that may be used in any of the herein described compositions, systems, methods, and kits can include an AAV1 vector, a modified AAV1 vector, an AAV2 vector, a modified AAV2 vector, an AAV3 vector, a modified AAV3 vector, an AAV4 vector, a modified AAV4 vector, an AAV5 vector, a modified AAV5 vector, an AAV6 vector, a modified AAV6 vector, an AAV7 vector, a modified AAV7 vector, an AAV8 vector, an AAV9 vector, an AAV.rh10 vector, a modified AAV.rh10 vector, an AAV.rh32/33 vector, a modified AAV.rh32/33 vector, an AAV.rh43 vector, a modified AAV.rh43 vector, an AAV.rh64R1 vector, and a modified AAV.rh64R1 vector and any combinations or equivalents thereof. In some embodiments, the lentiviral vector is an integrase-competent lentiviral vector (ICLV). In some embodiments, the lentiviral vector can refer to the transgene plasmid vector as well as the transgene plasmid vector in conjunction with related plasmids (e.g., a packaging plasmid, a rev expressing plasmid, an envelope plasmid) as well as a lentiviral-based particle capable of introducing exogenous nucleic acid into a cell through a viral or viral-like entry mechanism. Lentiviral vectors are well-known in the art (see, e.g., Trono D. (2002) Lentiviral vectors, New York: Spring-Verlag Berlin Heidelberg and Durand et al. (2011) *Viruses* 3(2):132-159 doi: 10.3390/v3020132). In some embodiments, exemplary lentiviral vectors that may be used in any of the herein described compositions, systems, methods, and kits can include a human immunodeficiency virus (HIV) 1 vector, a modified human immunodeficiency virus (HIV) 1 vector, a human immunodeficiency virus (HIV) 2 vector, a modified human immunodeficiency virus (HIV) 2 vector, a sooty mangabey simian immunodeficiency virus (SIVsM) vector, a modified sooty mangabey simian immunodeficiency virus (SIVsM) vector, a African green monkey simian immunodeficiency virus (SIVAGm) vector, a modified African green monkey simian immunodeficiency virus (SIVAGm) vector, an equine infectious anemia virus (EIAV) vector, a modified equine infectious anemia virus (EIAV) vector, a feline immunodeficiency virus (FIV) vector, a modified feline immunodeficiency virus (FIV) vector, a Visna/maedi virus (VNV/VMV) vector, a modified Visna/maedi virus (VNV/VMV) vector, a caprine arthritis-encephalitis virus (CAEV) vector, a modified caprine arthritis-encephalitis virus (CAEV) vector, a bovine immunodeficiency virus (BIV), or a modified bovine immunodeficiency virus (BIV).

Nucleic Acids

Provided herein are the nucleic acid sequences encoding the fusion proteins disclosed herein for use in gene transfer and expression techniques described herein. It should be understood, although not always explicitly stated that the sequences provided herein can be used to provide the expression product as well as substantially identical sequences that produce a protein that has the same biological properties. These "biologically equivalent" or "biologically active" or "equivalent" polypeptides are encoded by equivalent polynucleotides as described herein. They may possess at least 60%, or alternatively, at least 65%, or alternatively, at least 70%, or alternatively, at least 75%, or alternatively, at least 80%, or alternatively at least 85%, or alternatively at least 90%, or alternatively at least 95% or alternatively at least 98%, identical primary amino acid sequence to the reference polypeptide when compared using sequence identity methods run under default conditions. Specific polypeptide sequences are provided as examples of particular embodiments. Modifications to the sequences to amino acids with alternate amino acids that have similar charge. Additionally, an equivalent polynucleotide is one that hybridizes under stringent conditions to the reference polynucleotide or its complement or in reference to a polypeptide, a polypeptide encoded by a polynucleotide that hybridizes to the reference encoding polynucleotide under stringent conditions or its complementary strand. Alternatively, an equivalent polypeptide or protein is one that is expressed from an equivalent polynucleotide.

The nucleic acid sequences (e.g., polynucleotide sequences) disclosed herein may be codon-optimized which is a technique well known in the art. In some embodiments disclosed herein, exemplary Cas sequences, such as e.g., SEQ ID NO: 46 (Cas13d), are codon optimized for expression in human cells. Codon optimization refers to the fact that different cells differ in their usage of particular codons. This codon bias corresponds to a bias in the relative abundance of particular tRNAs in the cell type. By altering the codons in the sequence to match with the relative abundance of corresponding tRNAs, it is possible to increase expression. It is also possible to decrease expression by deliberately choosing codons for which the corresponding tRNAs are known to be rare in a particular cell type. Codon usage tables are known in the art for mammalian cells, as well as for a variety of other organisms. Based on the genetic code, nucleic acid sequences coding for, e.g., a Cas protein, can be generated. In some embodiments, such a sequence is optimized for expression in a host or target cell, such as a host cell used to express the Cas protein or a cell in which the disclosed methods are practiced (such as in a mammalian cell, e.g., a human cell). Codon preferences and codon usage tables for a particular species can be used to engineer isolated nucleic acid molecules encoding a Cas protein (such as one encoding a protein having at least 80%, at least 85%, at least 90%, at least 92%, at least 95%, at least 96%, at least 97%, at least 98%, at least 99%, or 100% sequence identity to its corresponding wild-type protein) that takes advantage of the codon usage preferences of that particular species. For example, the Cas proteins disclosed herein can be designed to have codons that are preferentially used by a particular organism of interest. In one example, an Cas nucleic acid sequence is optimized for expression in human cells, such as one having at least 70%, at least 80%, at least 85%, at least 90%, at least 92%, at least 95%, at least 98%, or at least 99% sequence identity to its corresponding wild-type or originating nucleic acid sequence. In some embodiments, an isolated nucleic acid molecule encoding at least one Cas protein (which can be part of a vector) includes at least one Cas protein coding sequence that is codon optimized for expression in a eukaryotic cell, or at least one Cas protein coding sequence codon optimized for expression in a human cell. In one embodiment, such a codon optimized Cas coding sequence has at least 80%, at least 85%, at least 90%, at least 92%, at least 95%, at least 96%, at least 97%, at least 98%, at least 99%, or 100% sequence identity to its corresponding wild-type or originating sequence. In another embodiment, a eukaryotic cell codon optimized nucleic acid sequence encodes a Cas protein having at least 85%, at least 90%, at least 92%, at least 95%, at least 96%, at least 97%, at least 98%, at least 99%, or 100% sequence identity to its corresponding wild-type or originating protein. In another embodiment, a variety of clones containing functionally equivalent nucleic acids may be routinely generated, such as nucleic acids which differ in sequence but which encode the same Cas protein sequence. Silent mutations in the coding sequence result from the degeneracy (i.e., redundancy) of the genetic code, whereby more than one codon can encode the same amino acid residue. Thus, for example, leucine can be encoded by CTT, CTC, CTA, CTG, TTA, or TTG; serine can be encoded by TCT, TCC, TCA, TCG, AGT, or AGC; asparagine can be encoded by AAT or AAC; aspartic acid can be encoded by GAT or GAC; cysteine can be encoded by TGT or TGC; alanine can be encoded by GCT, GCC, GCA, or GCG; glutamine can be encoded by CAA or CAG; tyrosine can be encoded by TAT or TAC; and isoleucine can be encoded by ATT, ATC, or ATA. Tables showing the standard genetic code can be found in various sources (see, for example, Stryer, 1988, Biochemistry, 3.sup.rd Edition, W.H. 5 Freeman and Co., NY).

"Hybridization" refers to a reaction in which one or more polynucleotides react to form a complex that is stabilized via hydrogen bonding between the bases of the nucleotide residues. The hydrogen bonding may occur by Watson-Crick base pairing, Hoogstein binding, or in any other sequence-specific manner. The complex may comprise two strands forming a duplex structure, three or more strands forming a multi-stranded complex, a single self-hybridizing strand, or any combination of these. A hybridization reaction may constitute a step in a more extensive process, such as the initiation of a PC reaction, or the enzymatic cleavage of a polynucleotide by a ribozyme.

Examples of stringent hybridization conditions include: incubation temperatures of about 25° C. to about 37° C.; hybridization buffer concentrations of about 6×SSC to about 10×SSC; formamide concentrations of about 0% to about 25%; and wash solutions from about 4×SSC to about 8×SSC. Examples of moderate hybridization conditions include: incubation temperatures of about 40° C. to about 50° C.; buffer concentrations of about 9×SSC to about 2×SSC; formamide concentrations of about 30% to about 50%; and wash solutions of about 5×SSC to about 2×SSC. Examples of high stringency conditions include: incubation temperatures of about 55° C. to about 68° C.; buffer concentrations of about 1×SSC to about 0.1×SSC; formamide concentrations of about 55% to about 75%; and wash solutions of about 1×SSC, 0.1×SSC, or deionized water. In general, hybridization incubation times are from 5 minutes to 24 hours, with 1, 2, or more washing steps, and wash incubation times are about 1, 2, or 15 minutes. SSC is 0.15 M NaCl and 15 mM citrate buffer. It is understood that equivalents of SSC using other buffer systems can be employed.

"Homology" or "identity" or "similarity" refers to sequence similarity between two peptides or between two nucleic acid molecules. Homology can be determined by comparing a position in each sequence which may be aligned for purposes of comparison. When a position in the compared sequence is occupied by the same base or amino acid, then the molecules are homologous at that position. A degree of homology between sequences is a function of the number of matching or homologous positions shared by the sequences. An "unrelated" or "non-homologous" sequence shares less than 40% identity, or alternatively less than 25% identity, with one of the sequences of the present invention.

Cells

In some embodiments of the compositions and methods of the disclosure, a cell of the disclosure is a prokaryotic cell.

In some embodiments of the compositions and methods of the disclosure, a cell of the disclosure is a eukaryotic cell. In some embodiments, the cell is a mammalian cell. In some embodiments, the cell is a bovine, murine, feline, equine, porcine, canine, simian, or human cell. In some embodiments, the cell is a non-human mammalian cell such as a non-human primate cell.

In some embodiments, a cell of the disclosure is a somatic cell. In some embodiments, a cell of the disclosure is a germline cell. In some embodiments, a germline cell of the disclosure is not a human cell.

In some embodiments of the compositions and methods of the disclosure, a cell of the disclosure is a stem cell. In some embodiments, a cell of the disclosure is an embryonic stem cell. In some embodiments, an embryonic stem cell of the disclosure is not a human cell. In some embodiments, a cell of the disclosure is a multipotent stem cell or a pluripotent stem cell. In some embodiments, a cell of the disclosure is an adult stem cell. In some embodiments, a cell of the disclosure is an induced pluripotent stem cell (iPSC). In some embodiments, a cell of the disclosure is a hematopoietic stem cell (HSC).

In some embodiments of the compositions and methods of the disclosure, a somatic cell of the disclosure is an immune cell. In some embodiments, an immune cell of the disclosure is a lymphocyte. In some embodiments, an immune cell of the disclosure is a T lymphocyte (also referred to herein as a T-cell). Exemplary T-cells of the disclosure include, but are not limited to, naïve T cells, effector T cells, helper T cells, memory T cells, regulatory T cells (Tregs) and Gamma delta T cells. In some embodiments, an immune cell of the disclosure is a B lymphocyte. In some embodiments, an immune cell of the disclosure is a natural killer cell. In some embodiments, an immune cell of the disclosure is an antigen-presenting cell.

In some embodiments of the compositions and methods of the disclosure, a somatic cell of the disclosure is a muscle cell. In some embodiments, a muscle cell of the disclosure is a myoblast or a myocyte. In some embodiments, a muscle cell of the disclosure is a cardiac muscle cell, skeletal muscle cell or smooth muscle cell. In some embodiments, a muscle cell of the disclosure is a striated cell.

In some embodiments of the compositions and methods of the disclosure, a somatic cell of the disclosure is an epithelial cell. In some embodiments, an epithelial cell of the disclosure forms a squamous cell epithelium, a cuboidal cell epithelium, a columnar cell epithelium, a stratified cell epithelium, a pseudostratified columnar cell epithelium or a transitional cell epithelium. In some embodiments, an epithelial cell of the disclosure forms a gland including, but not limited to, a pineal gland, a thymus gland, a pituitary gland, a thyroid gland, an adrenal gland, an apocrine gland, a holocrine gland, a merocrine gland, a serous gland, a mucous gland and a sebaceous gland. In some embodiments, an epithelial cell of the disclosure contacts an outer surface of an organ including, but not limited to, a lung, a spleen, a stomach, a pancreas, a bladder, an intestine, a kidney, a gallbladder, a liver, a larynx or a pharynx. In some embodiments, an epithelial cell of the disclosure contacts an outer surface of a blood vessel or a vein.

In some embodiments of the compositions and methods of the disclosure, a somatic cell of the disclosure is a neuronal cell. In some embodiments, a neuron cell of the disclosure is a neuron of the central nervous system. In some embodiments, a neuron cell of the disclosure is a neuron of the brain or the spinal cord. In some embodiments, a neuron cell of the disclosure is a neuron of the retina. In some embodiments, a neuron cell of the disclosure is a neuron of a cranial nerve or an optic nerve. In some embodiments, a neuron cell of the disclosure is a neuron of the peripheral nervous system. In some embodiments, a neuron cell of the disclosure is a neuroglial or a glial cell. In some embodiments, a glial of the disclosure is a glial cell of the central nervous system including, but not limited to, oligodendrocytes, astrocytes, ependymal cells, and microglia. In some embodiments, a glial of the disclosure is a glial cell of the peripheral nervous system including, but not limited to, Schwann cells and satellite cells.

In some embodiments of the compositions and methods of the disclosure, a somatic cell of the disclosure is a primary cell.

In some embodiments of the compositions and methods of the disclosure, a somatic cell of the disclosure is a cultured cell.

In some embodiments of the compositions and methods of the disclosure, a somatic cell of the disclosure is in vivo, in vitro, ex vivo or in situ.

In some embodiments of the compositions and methods of the disclosure, a somatic cell of the disclosure is autologous or allogeneic.

Methods of Use

The disclosure provides a method of modifying level of expression of an RNA molecule of the disclosure or a protein encoded by the RNA molecule comprising contacting the composition and the RNA molecule under conditions suitable for binding of one or more of the guide RNA or the fusion protein (or a portion thereof) to the RNA molecule.

The disclosure provides a method of modifying an activity of a protein encoded by an RNA molecule comprising contacting the composition and the RNA molecule under conditions suitable for binding of one or more of the guide RNA or the fusion protein (or a portion thereof) to the RNA molecule.

The disclosure provides a method of modifying level of expression of an RNA molecule of the disclosure or a protein encoded by the RNA molecule comprising contacting the composition and a cell comprising the RNA molecule under conditions suitable for binding of one or more of the guide RNA or the fusion protein (or a portion thereof) to the RNA molecule. In some embodiments, the cell is in vivo, in vitro, ex vivo or in situ. In some embodiments, the composition comprises a vector comprising composition comprising a guide RNA of the disclosure and a fusion protein of the disclosure. In some embodiments, the vector is an AAV.

The disclosure provides a method of modifying an activity of a protein encoded by an RNA molecule comprising contacting the composition and a cell comprising the RNA molecule under conditions suitable for binding of one or more of the guide RNA or the fusion protein (or a portion thereof) to the RNA molecule. In some embodiments, the cell is in vivo, in vitro, ex vivo or in situ. In some embodiments, the composition comprises a vector comprising composition comprising a guide RNA or a single guide RNA of the disclosure and a fusion protein of the disclosure. In some embodiments, the vector is an AAV.

The disclosure provides a method of modifying level of expression of an RNA molecule of the disclosure or a protein encoded by the RNA molecule comprising contacting the composition and the RNA molecule under conditions suitable for RNA nuclease activity wherein the fusion protein induces a break in the RNA molecule.

The disclosure provides a method of modifying an activity of a protein encoded by an RNA molecule comprising contacting the composition and the RNA molecule under conditions suitable for RNA nuclease activity wherein the fusion protein induces a break in the RNA molecule.

The disclosure provides a method of modifying a level of expression of an RNA molecule of the disclosure or a protein encoded by the RNA molecule comprising contacting the composition and a cell comprising the RNA molecule under conditions suitable for RNA nuclease activity wherein the fusion protein induces a break in the RNA molecule. In some embodiments, the cell is in vivo, in vitro, ex vivo or in situ. In some embodiments, the composition comprises a vector comprising composition comprising a guide RNA of the disclosure and a fusion protein of the disclosure. In some embodiments, the vector is an AAV.

The disclosure provides a method of modifying an activity of a protein encoded by an RNA molecule comprising contacting the composition and a cell comprising the RNA molecule under conditions suitable for RNA nuclease activity wherein the fusion protein induces a break in the RNA molecule. In some embodiments, the cell is in vivo, in vitro, ex vivo or in situ. In some embodiments, the composition comprises a vector comprising composition comprising a guide RNA or a single guide RNA of the disclosure and a fusion protein of the disclosure. In some embodiments, the vector is an AAV.

The disclosure provides a method of treating a disease or disorder comprising administering to a subject a therapeutically effective amount of a composition of the disclosure.

The disclosure provides a method of treating a disease or disorder comprising administering to a subject a therapeutically effective amount of a composition of the disclosure, wherein the composition comprises a vector comprising composition comprising a guide RNA of the disclosure and a fusion protein of the disclosure and wherein the composition modifies a level of expression of an RNA molecule of the disclosure or a protein encoded by the RNA molecule.

The disclosure provides a method of treating a disease or disorder comprising administering to a subject a therapeutically effective amount of a composition of the disclosure, wherein the composition comprises a vector comprising composition comprising a guide RNA of the disclosure and a fusion protein of the disclosure and wherein the composition modifies an activity of a protein encoded by an RNA molecule.

In some embodiments of the compositions and methods of the disclosure, a disease or disorder of the disclosure includes, but is not limited to, a genetic disease or disorder. In some embodiments, the genetic disease or disorder is a single-gene disease or disorder. In some embodiments, the single-gene disease or disorder is an autosomal dominant disease or disorder, an autosomal recessive disease or disorder, an X-chromosome linked (X-linked) disease or disorder, an X-linked dominant disease or disorder, an X-linked recessive disease or disorder, a Y-linked disease or disorder or a mitochondrial disease or disorder. In some embodiments, the genetic disease or disorder is a multiple-gene disease or disorder. In some embodiments, the genetic disease or disorder is a multiple-gene disease or disorder. In some embodiments, the single-gene disease or disorder is an autosomal dominant disease or disorder including, but not limited to, Huntington's disease, neurofibromatosis type 1, neurofibromatosis type 2, Marfan syndrome, hereditary nonpolyposis colorectal cancer, hereditary multiple exostoses, Von Willebrand disease, and acute intermittent porphyria. In some embodiments, the single-gene disease or disorder is an autosomal recessive disease or disorder including, but not limited to, Albinism, Medium-chain acyl-CoA dehydrogenase deficiency, cystic fibrosis, sickle-cell disease, Tay-Sachs disease, Niemann-Pick disease, spinal muscular atrophy, and Roberts syndrome. In some embodiments, the single-gene disease or disorder is X-linked disease or disorder including, but not limited to, muscular dystrophy, Duchenne muscular dystrophy, Hemophilia, Adrenoleukodystrophy (ALD), Rett syndrome, and Hemophilia A. In some embodiments, the single-gene disease or disorder is a mitochondrial disorder including, but not limited to, Leber's hereditary optic neuropathy.

In some embodiments of the compositions and methods of the disclosure, a disease or disorder of the disclosure includes, but is not limited to, an immune disease or disorder. In some embodiments, the immune disease or disorder is an immunodeficiency disease or disorder including, but not limited to, B-cell deficiency, T-cell deficiency, neutropenia, asplenia, complement deficiency, acquired immunodeficiency syndrome (AIDS) and immunodeficiency due to medical intervention (immunosuppression as an intended or adverse effect of a medical therapy). In some embodiments, the immune disease or disorder is an autoimmune disease or disorder including, but not limited to, Achalasia, Addison's disease, Adult Still's disease, Agammaglobulinemia, Alopecia areata, Amyloidosis, Anti-GBM/Anti-TBM nephritis, Antiphospholipid syndrome, Autoimmune angioedema, Autoimmune dysautonomia, Autoimmune encephalomyelitis, Autoimmune hepatitis, Autoimmune inner ear disease (AIED), Autoimmune myocarditis, Autoimmune oophoritis, Autoimmune orchitis, Autoimmune pancreatitis, Autoimmune retinopathy, Autoimmune urticaria, Axonal & neuronal neuropathy (AMAN), Baló disease, Behcet's disease, Benign mucosal pemphigoid, Bullous pemphigoid, Castleman disease (CD), Celiac disease, Chagas disease, Chronic inflammatory demyelinating polyneuropathy (CIDP), Chronic recurrent multifocal osteomyelitis (CRMO), Churg-Strauss Syndrome (CSS) or Eosinophilic Granulomatosis (EGPA), Cicatricial pemphigoid, Cogan's syndrome, Cold agglutinin disease, Congenital heart block, Coxsackie myocarditis, CREST syndrome, Crohn's disease, Dermatitis herpetiformis, Dermatomyositis, Devic's disease (neuromyelitis optica), Discoid lupus, Dressler's syndrome, Endometriosis, Eosinophilic esophagitis (EoE), Eosinophilic fasciitis, Erythema nodosum, Essential mixed cryoglobulinemia, Evans syndrome, Fibromyalgia, Fibrosing alveolitis, Giant cell arteritis (temporal arteritis), Giant cell myocarditis, Glomerulonephritis, Goodpasture's syndrome, Granulomatosis with Polyangiitis, Graves' disease, Guillain-Barre syndrome, Hashimoto's thyroiditis, Hemolytic anemia, Henoch-Schonlein purpura (HSP), Herpes gestationis or pemphigoid gestationis (PG), Hidradenitis Suppurativa (HS) (Acne Inversa), Hypogammalglobulinemia, IgA Nephropathy, IgG4-related sclerosing disease, Immune thrombocytopenic purpura (ITP), Inclusion body myositis (IBM), Interstitial cystitis (IC), Juvenile arthritis, Juvenile diabetes (Type 1 diabetes), Juvenile myositis (JM), Kawasaki disease, Lambert-Eaton syndrome, Leukocytoclastic vasculitis, Lichen planus, Lichen sclerosus, Ligneous conjunctivitis, Linear IgA disease (LAD), Lupus, Lyme disease chronic, Meniere's disease, Microscopic polyangiitis (MPA), Mixed connective tissue disease (MCTD), Mooren's ulcer, Mucha-Habermann disease, Multifocal Motor Neuropathy (MMN) or MMNCB, Multiple sclerosis, Myasthenia gravis, Myositis, Narcolepsy, Neonatal Lupus, Neuromyelitis optica, Neutropenia, Ocular cicatricial pemphigoid, Optic neuritis, Palindromic rheumatism (PR), PANDAS, Paraneoplastic cerebellar degeneration (PCD), Paroxysmal nocturnal hemoglobinuria (PNH), Parry Romberg syndrome, Pars planitis (peripheral uveitis), Parsonnage-Turner syndrome, Pemphigus, Peripheral neuropathy, Perivenous encephalomyelitis, Pernicious anemia (PA), POEMS syndrome, Polyarteritis *nodosa*, Polyglandular syndromes type I, II, III, Polymyalgia rheumatica, Polymyositis, Postmyocardial infarction syndrome, Postpericardiotomy syndrome, Primary biliary cirrhosis, Primary sclerosing cholangitis, Progesterone dermatitis, Psoriasis, Psoriatic arthritis, Pure red cell aplasia (PRCA), Pyoderma gangrenosum, Raynaud's phenomenon, Reactive Arthritis, Reflex sympathetic dystrophy, Relapsing polychondritis, Restless legs syndrome (RLS), Retroperitoneal fibrosis, Rheumatic fever, Rheumatoid arthritis, Sarcoidosis, Schmidt syndrome, Scleritis, Scleroderma, Sjögren's syndrome, Sperm & testicular autoimmunity, Stiff person syndrome (SPS), Subacute bacterial endocarditis (SBE), Susac's syndrome, Sympathetic ophthalmia (SO), Takayasu's arteritis, Temporal arteritis/Giant cell arteritis, Thrombocytopenic purpura (TTP), Tolosa-Hunt syndrome (THS), Transverse myelitis, Type 1 diabetes, Ulcerative colitis (UC), Undifferentiated connective tissue disease (UCTD), Uveitis, Vasculitis, Vitiligo, Vogt-Koyanagi-Harada Disease, or Wegener's granulomatosis.

In some embodiments of the compositions and methods of the disclosure, a disease or disorder of the disclosure includes, but is not limited to, an inflammatory disease or disorder.

In some embodiments of the compositions and methods of the disclosure, a disease or disorder of the disclosure includes, but is not limited to, a metabolic disease or disorder.

In some embodiments of the compositions and methods of the disclosure, a disease or disorder of the disclosure includes, but is not limited to, a degenerative or a progressive disease or disorder. In some embodiments, the degenerative or a progressive disease or disorder includes, but is not limited to, amyotrophic lateral sclerosis (ALS), Huntington's disease, Alzheimer's disease, and aging.

In some embodiments of the compositions and methods of the disclosure, a disease or disorder of the disclosure includes, but is not limited to, an infectious disease or disorder.

In some embodiments of the compositions and methods of the disclosure, a disease or disorder of the disclosure includes, but is not limited to, a pediatric or a developmental disease or disorder.

In some embodiments of the compositions and methods of the disclosure, a disease or disorder of the disclosure includes, but is not limited to, a cardiovascular disease or disorder.

In some embodiments of the compositions and methods of the disclosure, a disease or disorder of the disclosure includes, but is not limited to, a proliferative disease or disorder. In some embodiments, the proliferative disease or disorder is a cancer. In some embodiments, the cancer includes, but is not limited to, Acute Lymphoblastic Leukemia (ALL), Acute Myeloid Leukemia (AML), Adrenocortical Carcinoma, AIDS-Related Cancers, Kaposi Sarcoma (Soft Tissue Sarcoma), AIDS-Related Lymphoma (Lymphoma), Primary CNS Lymphoma (Lymphoma), Anal Cancer, Appendix Cancer, Gastrointestinal Carcinoid Tumors, Astrocytomas, Atypical Teratoid/Rhabdoid Tumor, Central Nervous System (Brain Cancer), Basal Cell Carcinoma, Bile Duct Cancer, Bladder Cancer, Bone Cancer, Ewing Sarcoma, Osteosarcoma, Malignant Fibrous Histiocytoma, Brain Tumors, Breast Cancer, Burkitt Lymphoma, Carcinoid Tumor, Carcinoma, Cardiac (Heart) Tumors, Embryonal Tumors, Germ Cell Tumor, Primary CNS Lymphoma, Cervical Cancer, Cholangiocarcinoma, Chordoma, Chronic Lymphocytic Leukemia (CLL), Chronic Myelogenous Leukemia (CML), Chronic Myeloproliferative Neoplasms, Colorectal Cancer, Craniopharyngioma, Cutaneous T-Cell Lymphoma, Ductal Carcinoma In Situ, Embryonal Tumors, Endometrial Cancer (Uterine Cancer), Ependymoma, Esophageal Cancer, Esthesioneuroblastoma (Head and Neck Cancer), Ewing Sarcoma (Bone Cancer), Extracranial Germ Cell Tumor, Extragonadal Germ Cell Tumor, Eye Cancer, Childhood Intraocular Melanoma, Intraocular Melanoma, Retinoblastoma, Fallopian Tube Cancer, Fibrous Histiocytoma of Bone, Malignant, and Osteosarcoma, Gallbladder Cancer, Gastric (Stomach) Cancer, Gastrointestinal Carcinoid Tumor, Gastrointestinal Stromal Tumors (GIST) (Soft Tissue Sarcoma), Childhood Gastrointestinal Stromal Tumors, Germ Cell Tumors, Childhood Extracranial Germ Cell Tumors, Extragonadal Germ Cell Tumors, Ovarian Germ Cell Tumors, Testicular Cancer, Gestational Trophoblastic Disease, Hairy Cell Leukemia, Head and Neck Cancer, Heart Tumors, Hepatocellular (Liver) Cancer, Histiocytosis, Hodgkin Lymphoma, Hypopharyngeal Cancer (Head and Neck Cancer), Intraocular Melanoma, Islet Cell Tumors, Pancreatic Neuroendocrine Tumors, Kaposi Sarcoma (Soft Tissue Sarcoma), Kidney (Renal Cell) Cancer, Langerhans Cell Histiocytosis, Laryngeal Cancer (Head and Neck Cancer), Leukemia, Lip and Oral Cavity Cancer (Head and Neck Cancer), Liver Cancer, Lung Cancer (Non-Small Cell and Small Cell), Childhood Lung Cancer, Lymphoma, Male Breast Cancer, Malignant Fibrous Histiocytoma of Bone and Osteosarcoma, Melanoma, Merkel Cell Carcinoma (Skin Cancer), Mesothelioma, Metastatic Squamous Neck Cancer with Occult Primary (Head and Neck Cancer), Midline Tract Carcinoma With NUT Gene Changes, Mouth Cancer (Head and Neck Cancer), Multiple Endocrine Neoplasia Syndromes, Multiple Myeloma/Plasma Cell Neoplasms, Mycosis Fungoides (Lymphoma), Myelodysplastic Syndromes, Myelodysplastic/Myeloproliferative Neoplasms, Nasal Cavity and Paranasal Sinus Cancer (Head and Neck Cancer), Nasopharyngeal Cancer (Head and Neck Cancer), Neuroblastoma, Non-Hodgkin Lymphoma, Non-Small Cell Lung Cancer, Oral Cancer, Lip and Oral Cavity Cancer and Oropharyngeal Cancer, Osteosarcoma and Malignant Fibrous Histiocytoma of Bone, Ovarian Cancer, Pancreatic Cancer, Pancreatic Neuroendocrine Tumors (Islet Cell Tumors), Papillomatosis, Paraganglioma, Parathyroid Cancer, Penile Cancer, Pharyngeal Cancer (Head and Neck Cancer), Pheochromocytoma, Plasma Cell Neoplasm/Multiple Myeloma, Pleuropulmonary Blastoma, Pregnancy and Breast Cancer, Primary Central Nervous System (CNS) Lymphoma, Primary Peritoneal Cancer, Prostate Cancer, Rectal Cancer, Recurrent Cancer, Renal Cell (Kidney) Cancer, Retinoblastoma, Rhabdomyosarcoma, Childhood (Soft Tissue Sarcoma), Salivary Gland Cancer (Head and Neck Cancer), Sarcoma, Childhood Rhabdomyosarcoma (Soft Tissue Sarcoma), Childhood Vascular Tumors (Soft Tissue Sarcoma), Ewing Sarcoma (Bone Cancer), Kaposi Sarcoma (Soft Tissue Sarcoma), Osteosarcoma (Bone Cancer), Uterine Sarcoma, Sézary Syndrome, Lymphoma, Skin Cancer, Small Cell Lung Cancer, Small Intestine Cancer, Soft Tissue Sarcoma, Squamous Cell Carcinoma of the Skin, Squamous Neck Cancer, Stomach (Gastric) Cancer, T-Cell Lymphoma, Testicular Cancer, Throat Cancer (Head and Neck Cancer), Nasopharyngeal Cancer, Oropharyngeal Cancer, Hypopharyngeal Cancer, Thymoma and Thymic Carcinoma, Thyroid Cancer, Transitional Cell Cancer of the Renal Pelvis and Ureter, Renal Cell Cancer, Urethral Cancer, Uterine Sarcoma, Vaginal Cancer, Vascular Tumors (Soft Tissue Sarcoma), Vulvar Cancer, Wilms Tumor and Other Childhood Kidney Tumors.

In some embodiments of the methods of the disclosure, a subject of the disclosure has been diagnosed with the disease or disorder. In some embodiments, the subject of the disclosure presents at least one sign or symptom of the disease or disorder. In some embodiments, the subject has a biomarker predictive of a risk of developing the disease or disorder. In some embodiments, the biomarker is a genetic mutation.

In some embodiments of the methods of the disclosure, a subject of the disclosure is female. In some embodiments of the methods of the disclosure, a subject of the disclosure is male. In some embodiments, a subject of the disclosure has two XX or XY chromosomes. In some embodiments, a subject of the disclosure has two XX or XY chromosomes and a third chromosome, either an X or a Y.

In some embodiments of the methods of the disclosure, a subject of the disclosure is a neonate, an infant, a child, an adult, a senior adult, or an elderly adult. In some embodiments of the methods of the disclosure, a subject of the disclosure is at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or 31 days old. In some embodiments of the methods of the disclosure, a subject of the disclosure is at least 1, 2, 3, 4, 5, 6, 7, 8, 9, 10, 11 or 12 months old. In some embodiments of the methods of the disclosure, a subject of the disclosure is at least 1, 2, 3, 4, 5, 6, 7, 8, 9, 10, 15, 20, 25, 30, 35, 40, 45, 50, 55, 60, 65, 70, 75, 80, 85, 90, 95, 100 or any number of years or partial years in between of age.

In some embodiments of the methods of the disclosure, a subject of the disclosure is a mammal. In some embodiments, a subject of the disclosure is a non-human mammal.

In some embodiments of the methods of the disclosure, a subject of the disclosure is a human.

In some embodiments of the methods of the disclosure, a therapeutically effective amount comprises a single dose of a composition of the disclosure. In some embodiments, a therapeutically effective amount comprises a therapeutically effective amount comprises at least one dose of a composition of the disclosure. In some embodiments, a therapeutically effective amount comprises a therapeutically effective amount comprises one or more dose(s) of a composition of the disclosure.

In some embodiments of the methods of the disclosure, a therapeutically effective amount eliminates a sign or symptom of the disease or disorder. In some embodiments, a therapeutically effective amount reduces a severity of a sign or symptom of the disease or disorder.

In some embodiments of the methods of the disclosure, a therapeutically effective amount eliminates the disease or disorder.

In some embodiments of the methods of the disclosure, a therapeutically effective amount prevents an onset of a disease or disorder. In some embodiments, a therapeutically effective amount delays the onset of a disease or disorder. In some embodiments, a therapeutically effective amount reduces the severity of a sign or symptom of the disease or disorder. In some embodiments, a therapeutically effective amount improves a prognosis for the subject.

In some embodiments of the methods of the disclosure, a composition of the disclosure is administered to the subject systemically. In some embodiments, the composition of the disclosure is administered to the subject by an intravenous route. In some embodiments, the composition of the disclosure is administered to the subject by an injection or an infusion.

In some embodiments of the methods of the disclosure, a composition of the disclosure is administered to the subject locally. In some embodiments, the composition of the disclosure is administered to the subject by an intraosseous, intraocular, intracerebrospinal or intraspinal route. In some embodiments, the composition of the disclosure is administered directly to the cerebral spinal fluid of the central nervous system. In some embodiments, the composition of the disclosure is administered directly to a tissue or fluid of the eye and does not have bioavailability outside of ocular structures. In some embodiments, the composition of the disclosure is administered to the subject by an injection or an infusion.

In some embodiments, the compositions comprising the RNA-binding fusion proteins disclosed herein are formulated as pharmaceutical compositions. Briefly, pharmaceutical compositions for use as disclosed herein may comprise a fusion protein(s) or a polynucleotide encoding the fusion protein(s), optionally comprised in an AAV, which is optionally also immune orthogonal, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the disclosure may be formulated for oral, intravenous, topical, enteral, intraocular, and/or parenteral administration. In certain embodiments, the compositions of the present disclosure are formulated for intravenous administration.

EXAMPLE EMBODIMENTS

Embodiment 1

A composition comprising:

(a) a sequence comprising a guide RNA (gRNA) that specifically binds a target sequence within an RNA molecule and (b) a sequence encoding a fusion protein, the sequence comprising a sequence encoding a first RNA-binding polypeptide and a sequence encoding a second RNA-binding polypeptide, wherein neither the first RNA-binding polypeptide nor the second RNA-binding polypeptide comprises a significant DNA-nuclease activity, wherein the first RNA-binding polypeptide and the second RNA-binding polypeptide are not identical, and wherein the second RNA-binding polypeptide comprises an RNA-nuclease activity; or a composition comprising nucleic acid sequence encoding a fusion protein, the fusion protein comprising a first RNA-binding polypeptide and a second RNA-binding polypeptide, wherein the first RNA-binding polypeptide is not a guided RNA-binding polypeptide, wherein the first RNA-binding polypeptide and the second RNA-binding polypeptide are not identical, and wherein the second RNA-binding polypeptide comprises an RNA-nuclease activity.

Embodiment 2

The composition of embodiment 1, wherein the target sequence comprises at least one repeated sequence.

Embodiment 3

The composition of embodiment 1 or 2, wherein the sequence comprising the gRNA comprises a promoter capable of expressing the gRNA in a eukaryotic cell.

Embodiment 4

The composition of embodiment 3, wherein the eukaryotic cell is an animal cell.

Embodiment 5

The composition of embodiment 4, wherein the animal cell is a mammalian cell.

Embodiment 6

The composition of embodiment 5, wherein the animal cell is a human cell.

Embodiment 7

The composition of any one of embodiments 1-6, wherein the promoter is a constitutively active promoter.

Embodiment 8

The composition of any one of embodiments 1-7, wherein the promoter is isolated or derived from a promoter capable of driving expression of an RNA polymerase.

Embodiment 9

The composition of embodiment 8, wherein the promoter is isolated or derived from a U6 promoter.

Embodiment 10

The composition of any one of embodiments 1-7, wherein the promoter is isolated or derived from a promoter capable of driving expression of a transfer RNA (tRNA).

Embodiment 11

The composition of embodiment 10, wherein the promoter is isolated or derived from an alanine tRNA promoter, an arginine tRNA promoter, an asparagine tRNA promoter, an aspartic acid tRNA promoter, a cysteine tRNA promoter, a glutamine tRNA promoter, a glutamic acid tRNA promoter, a glycine tRNA promoter, a histidine tRNA promoter, an isoleucine tRNA promoter, a leucine tRNA promoter, a lysine tRNA promoter, a methionine tRNA promoter, a phenylalanine tRNA promoter, a proline tRNA promoter, a serine tRNA promoter, a threonine tRNA promoter, a tryptophan tRNA promoter, a tyrosine tRNA promoter, or a valine tRNA promoter.

Embodiment 12

The composition of embodiment 10, wherein the promoter is isolated or derived from a valine tRNA promoter.

Embodiment 13

The composition of any one of embodiments 1-12, wherein the sequence comprising the gRNA comprises a spacer sequence that specifically binds to the target RNA sequence.

Embodiment 14

The composition of embodiment 13, wherein the spacer sequence has at least 50%, 55%, 60%, 65%, 70%, 75%, 80%, 87%, 90%, 95%, 97%, 99% or any percentage in between of complementarity to the target RNA sequence.

Embodiment 15

The composition of embodiment 13, wherein the spacer sequence has 100% complementarity to the target RNA sequence.

Embodiment 16

The composition of any one of embodiments 13-15, wherein the spacer sequence comprises or consists of 20 nucleotides.

Embodiment 17

The composition of any one of embodiments 13-15, wherein the spacer sequence comprises or consists of 21 nucleotides.

Embodiment 18

The composition of embodiment 17, wherein the spacer sequence comprises the sequence UGGAGCGAGCAUC-CCCCAAA (SEQ ID NO: 1), GUUUGGGGGAUGCUCG-CUCCA (SEQ ID NO: 2), CCCUCACUGCUGGGGA-GUCC (SEQ ID NO: 3), GGACUCCCCAGCAGUGAGGG (SEQ ID NO: 4), GCAACUGGAUCAAUUUGCUG (SEQ ID NO: 5), GCAGCAAAUUGAUCCAGUUGC (SEQ ID NO: 6), GCAUUCUUAUCUGGUCAGUGC (SEQ ID NO: 7), GCACUGACCAGAUAAGAAUG (SEQ ID NO: 8), GAGCAGCAGCAGCAGCAGCAG (SEQ ID NO: 9), GCAGGCAGGCAGGCAGGCAGG (SEQ ID NO: 10), GCCCCGGCCCCGGCCCCGGC (SEQ ID NO: 11), or GCTGCTGCTGCTGCTGCTGC (SEQ ID NO: 12), GGGGCCGGGGCCGGGGCCGG (SEQ ID NO: 74), GGGCCGGGGCCGGGGCCGGG (SEQ ID NO: 75), GGCCGGGGCCGGGGCCGGGG (SEQ ID NO: 76), GCCGGGGCCGGGGCCGGGGC (SEQ ID NO: 77), CCGGGGCCGGGGCCGGGGCC (SEQ ID NO: 78), CGGGGCCGGGGCCGGGGCCG (SEQ ID NO: 79).

Embodiment 19

The composition of any one of embodiments 1-18, wherein the sequence comprising the gRNA comprises a scaffold sequence that specifically binds to the first RNA binding protein.

Embodiment 20

The composition of embodiment 19, wherein the scaffold sequence comprises a stem-loop structure.

Embodiment 21

The composition of embodiment 19 or 20, wherein the scaffold sequence comprises or consists of 90 nucleotides.

Embodiment 22

The composition of embodiment 19 or 20, wherein the scaffold sequence comprises or consists of 93 nucleotides.

Embodiment 23

The composition of embodiment 22, wherein the scaffold sequence comprises the sequence (SEQ ID NO: 13)
GUUUAAGAGCUAUGCUGGAAACAGCAUAGCAAGUUUAAAUAAGGCUAGUC

CGUUAUCAACUUGAAAAAGUGGCACCGAGUCGGUGCUUUUUUU.

Embodiment 24

The composition of embodiment 16, wherein the spacer sequence comprises the sequence GUGAUAAGUG-GAAUGCCAUG (SEQ ID NO: 14), CUGGUGAACUUC-CGAUAGUG (SEQ ID NO: 15), or GAGATATAGCCTG-GTGGTTC (SEQ ID NO: 16).

Embodiment 25

The composition of embodiment 19 or 24, wherein the scaffold sequence comprises a step-loop structure.

Embodiment 26

The composition of embodiment 25, wherein the scaffold sequence comprises or consists of 85 nucleotides.

Embodiment 27

The composition of embodiment 26, wherein the scaffold sequence comprises the sequence

```
                                           (SEQ ID NO: 17)
GGACAGCAUAGCAAGUUAAAAUAAGGCUAGUCCGUUAUCAACUUGAAAAA
GUGGCACCGAGUCGGUGCUUUUU.
```

Embodiment 28

The composition of embodiment 16, wherein the spacer sequence comprises the sequence at least 1, 2, 3, 4, 5, 6, or 7 repeats of the sequence CUG (SEQ ID NO: 18), CCUG (SEQ ID NO: 19), CAG (SEQ ID NO: 80), GGGGCC (SEQ ID NO: 81) or any combination thereof.

Embodiment 29

The composition of embodiment 28, wherein the sequence comprising the gRNA comprises a scaffold sequence that specifically binds to the first RNA binding protein.

Embodiment 30

The composition of embodiment 29, wherein the scaffold sequence comprises a stem-loop structure.

Embodiment 31

The composition of embodiment 29 or 30, wherein the scaffold sequence comprises or consists of 90 nucleotides.

Embodiment 32

The composition of embodiment 30 or 31, wherein the scaffold sequence comprises or consists of 93 nucleotides.

Embodiment 33

The composition of embodiment 32, wherein the scaffold sequence comprises the sequence

```
                                           (SEQ ID NO: 82)
GUUUAAGAGCUAUGCUGGAAACAGCAUAGCAAGUUUAAAUAAGGCUAGUC
CGUUAUCAACUUGAAAAGUGGCACCGAGUCGGUGCUUUUUUU
or
                                           (SEQ ID NO: 83)
GUUUUAGAGCUAGAAAUAGCAAGUUAAAAUAAGGCUAGUCCGUUAUCAAC
UUGAAAAAGUGGCACCGAGUCGGUGCUUUUUUU.
```

Embodiment 34

The composition of any one of embodiments 1-33, wherein the gRNA does not bind or does not selectively bind to a second sequence within the RNA molecule.

Embodiment 35

The composition of embodiment 34, wherein an RNA genome or an RNA transcriptome comprises the RNA molecule.

Embodiment 36

The composition of any one of embodiments 1-35, wherein the first RNA binding protein comprises a CRISPR-Cas protein.

Embodiment 37

The composition of embodiment 36, wherein the CRISPR-Cas protein is a Type II CRISPR-Cas protein.

Embodiment 38

The composition of embodiment 37, wherein the first RNA binding protein comprises a Cas9 polypeptide or an RNA-binding portion thereof.

Embodiment 39

The composition of embodiment 36, wherein the CRISPR-Cas protein is a Type V CRISPR-Cas protein.

Embodiment 40

The composition of embodiment 39, wherein the first RNA binding protein comprises a Cpf1 polypeptide or an RNA-binding portion thereof.

Embodiment 41

The composition of embodiment 36, wherein the CRISPR-Cas protein is a Type VI CRISPR-Cas protein.

Embodiment 42

The composition of embodiment 41, wherein the first RNA binding protein comprises a Cas13 polypeptide or an RNA-binding portion thereof.

Embodiment 43

The composition of any one of embodiments 36-42, wherein the CRISPR-Cas protein comprises a native RNA nuclease activity.

Embodiment 44

The composition of embodiment 43, wherein the native RNA nuclease activity is reduced or inhibited.

Embodiment 45

The composition of embodiment 43, wherein the native RNA nuclease activity is increased or induced.

Embodiment 46

The composition of any one of embodiments 36-45, wherein the CRISPR-Cas protein comprises a native DNA nuclease activity and wherein the native DNA nuclease activity is inhibited.

Embodiment 47

The composition of embodiment 46, wherein the CRISPR-Cas protein comprises a mutation.

Embodiment 48

The composition of embodiment 47, wherein a nuclease domain of the CRISPR-Cas protein comprises the mutation.

Embodiment 49

The composition of embodiment 47, wherein the mutation occurs in a nucleic acid encoding the CRISPR-Cas protein.

Embodiment 50

The composition of embodiment 47, wherein the mutation occurs in an amino acid encoding the CRISPR-Cas protein.

Embodiment 51

The composition of any one of embodiments 47-50, wherein the mutation comprises a substitution, an insertion, a deletion, a frameshift, an inversion, or a transposition.

Embodiment 52

The composition of any one of embodiments 47-50, wherein the mutation comprises a deletion of a nuclease domain, a binding site within the nuclease domain, an active site within the nuclease domain, or at least one essential amino acid residue within the nuclease domain.

Embodiment 53

The composition of any one of embodiments 1-35, wherein the first RNA binding protein comprises a Pumilio and FBF (PUF) protein.

Embodiment 54

The composition of embodiment 53, wherein the first RNA binding protein comprises a Pumilio-based assembly (PUMBY) protein.

Embodiment 55

The composition of any one of embodiments 1-54, wherein the first RNA binding protein does not require multimerization for RNA-binding activity.

Embodiment 56

The composition of embodiment 55, wherein the first RNA binding protein is not a monomer of a multimer complex

Embodiment 57

The composition of embodiment 55, wherein a multimer protein complex does not comprise the first RNA binding protein.

Embodiment 58

The composition of any one of embodiments 1-57, wherein the first RNA binding protein selectively binds to a target sequence within the RNA molecule.

Embodiment 59

The composition of embodiment 58, wherein the first RNA binding protein does not comprise an affinity for a second sequence within the RNA molecule.

Embodiment 60

The composition of embodiment 58 or 59, wherein the first RNA binding protein does not comprise a high affinity for or selectively bind a second sequence within the RNA molecule.

Embodiment 61

The composition of embodiment 60, wherein an RNA genome or an RNA transcriptome comprises the RNA molecule.

Embodiment 62

The composition of any one of embodiments 1-61, wherein the first RNA binding protein comprises between 2 and 1300 amino acids, inclusive of the endpoints.

Embodiment 63

The composition of any one of embodiments 1-62, wherein the sequence encoding the first RNA binding protein further comprises a sequence encoding a nuclear localization signal (NLS).

Embodiment 64

The composition of embodiment 63, wherein the sequence encoding a nuclear localization signal (NLS) is positioned 3' to the sequence encoding the first RNA binding protein.

Embodiment 65

The composition of embodiment 64, wherein the first RNA binding protein comprises an NLS at a C-terminus of the protein.

Embodiment 66

The composition of any one of embodiments 1-62, wherein the sequence encoding the first RNA binding protein further comprises a first sequence encoding a first NLS and a second sequence encoding a second NLS.

Embodiment 67

The composition of embodiment 66, wherein the sequence encoding the first NLS or the second NLS is positioned 3' to the sequence encoding the first RNA binding protein.

Embodiment 68

The composition of embodiment 67, wherein the first RNA binding protein comprises the first NLS or the second NLS at a C-terminus of the protein.

Embodiment 69

The composition of any one of embodiments 1-68, wherein the second RNA binding protein comprises or consists of a nuclease domain.

Embodiment 70

The composition of embodiment 69, wherein the sequence encoding the second RNA binding protein comprises or consists of an RNAse.

Embodiment 71

The composition of embodiment 70, wherein the second RNA binding protein comprises or consists of an RNAse1.

Embodiment 72

The composition of embodiment 71, wherein the RNAse1 protein comprises or consists of SEQ ID NO: 20.

Embodiment 73

The composition of embodiment 72, wherein the second RNA binding protein comprises or consists of an RNAse4.

Embodiment 74

The composition of embodiment 73, wherein the RNAse4 protein comprises or consists of: (SEQ ID NO: 21.

Embodiment 75

The composition of embodiment 70, wherein the second RNA binding protein comprises or consists of an RNAse6.

Embodiment 76

The composition of embodiment 75, wherein the RNAse6 protein comprises or consists of SEQ ID NO: 22.

Embodiment 77

The composition of embodiment 70, wherein the second RNA binding protein comprises or consists of an RNAse7.

Embodiment 78

The composition of embodiment 77, wherein the RNAse7 protein comprises or consists of SEQ ID NO: 23.

Embodiment 79

The composition of embodiment 70, wherein the second RNA binding protein comprises or consists of an RNAse8.

Embodiment 80

The composition of embodiment 79, wherein the RNAse8 protein comprises or consists of SEQ ID NO: 24.

Embodiment 81

The composition of embodiment 70, wherein the second RNA binding protein comprises or consists of an RNAse2.

Embodiment 82

The composition of embodiment 81, wherein the RNAse2 protein comprises or consists of SEQ ID NO: 25.

Embodiment 83

The composition of embodiment 70, wherein the second RNA binding protein comprises or consists of an RNAse6PL.

Embodiment 84

The composition of embodiment 83, wherein the RNAse6PL protein comprises or consists of SEQ ID NO: 26.

Embodiment 85

The composition of embodiment 70, wherein the second RNA binding protein comprises or consists of an RNAseL.

Embodiment 86

The composition of embodiment 85, wherein the RNAseL protein comprises or consists of SEQ ID NO: 27.

Embodiment 87

The composition of embodiment 70, wherein the second RNA binding protein comprises or consists of an RNAseT2.

Embodiment 88

The composition of embodiment 87, wherein the RNAseT2 protein comprises or consists of SEQ ID NO: 28.

Embodiment 89

The composition of embodiment 70, wherein the second RNA binding protein comprises or consists of an RNAse11.

Embodiment 90

The composition of embodiment 89, wherein the RNAse11 comprises or consists of SEQ ID NO: 29.

Embodiment 91

The composition of embodiment 70, wherein the second RNA binding protein comprises or consists of an RNAseT2-like.

Embodiment 92

The composition of embodiment 91, wherein the RNAseT2-like protein comprises or consists of SEQ ID NO: 30.

Embodiment 93

The composition of embodiment 69, wherein the second RNA binding protein comprises or consists of a NOB1 polypeptide.

Embodiment 94

The composition of embodiment 93, wherein the NOB1 polypeptide comprises or consists of SEQ ID NO: 31.

Embodiment 95

The composition of embodiment 69, wherein the second RNA binding protein comprises or consists of an endonuclease.

Embodiment 96

The composition of embodiment 95, wherein the second RNA binding protein comprises or consists of an endonuclease V (ENDOV).

Embodiment 97

The composition of embodiment 96, wherein the ENDOV protein comprises or consists of SEQ ID NO: 32.

Embodiment 98

The composition of embodiment 95, wherein the second RNA binding protein comprises or consists of an endonuclease G (ENDOG).

Embodiment 99

The composition of embodiment 98, wherein the ENDOG protein comprises or consists of SEQ ID NO: 33.

Embodiment 100

The composition of embodiment 95, wherein the second RNA binding protein comprises or consists of an endonuclease D1 (ENDOD1).

Embodiment 101

The composition of embodiment 100, wherein the ENDOD1 protein comprises or consists of SEQ ID NO: 34.

Embodiment 102

The composition of embodiment 95, wherein the second RNA binding protein comprises or consists of a Human flap endonuclease-1 (hFEN1).

Embodiment 103

The composition of embodiment 102, wherein the hFEN1 protein comprises or consists of SEQ ID NO: 35.

Embodiment 104

The composition of embodiment 69, wherein the second RNA binding protein comprises or consists of a human Schlafen 14 (hSLFN14) polypeptide.

Embodiment 105

The composition of embodiment 104, wherein the hSLFN14 polypeptide comprises or consists of SEQ ID NO: 36.

Embodiment 106

The composition of embodiment 69, wherein the second RNA binding protein comprises or consists of a human beta-lactamase-like protein 2 (hLACTB2) polypeptide.

Embodiment 107

The composition of embodiment 106, wherein the hLACTB2 polypeptide comprises or consists of SEQ ID NO: 37.

Embodiment 108

The composition of embodiment 69, wherein the second RNA binding protein comprises or consists of an apurinic/apyrimidinic (AP) endodeoxyribonuclease (APEX2) polypeptide.

Embodiment 109

The composition of embodiment 108, wherein the APEX2 polypeptide comprises or consists of SEQ ID NO: 38.

Embodiment 110

The composition of embodiment 108, wherein the APEX2 polypeptide comprises or consists of: SEQ ID NO: 39.

Embodiment 111

The composition of embodiment 69, wherein the second RNA binding protein comprises or consists of an angiogenin (ANG) polypeptide.

Embodiment 112

The composition of embodiment 111, wherein the ANG polypeptide comprises or consists of SEQ ID NO: 40.

Embodiment 113

The composition of embodiment 69, wherein the second RNA binding protein comprises or consists of a heat responsive protein 12 (HRSP12) polypeptide.

Embodiment 114

The composition of embodiment 113, wherein the HRSP12 polypeptide comprises or consists of SEQ ID NO: 41.

Embodiment 115

The composition of embodiment 69, wherein the second RNA binding protein comprises or consists of a Zinc Finger CCCH-Type Containing 12A (ZC3H12A) polypeptide.

Embodiment 116

The composition of embodiment 115, wherein the ZC3H12A polypeptide comprises or consists of SEQ ID NO: 42.

Embodiment 117

The composition of embodiment 115, wherein the ZC3H12A polypeptide comprises or consists of SEQ ID NO: 43.

Embodiment 118

The composition of embodiment 69, wherein the second RNA binding protein comprises or consists of a Reactive Intermediate Imine Deaminase A (RIDA) polypeptide.

Embodiment 119

The composition of embodiment 118, wherein the RIDA polypeptide comprises or consists of SEQ ID NO: 44.

Embodiment 120

The composition of embodiment 69, wherein the second RNA binding protein comprises or consists of a Phospholipase D Family Member 6 (PDL6) polypeptide.

Embodiment 121

The composition of embodiment 120, wherein the PDL6 polypeptide comprises or consists of: (SEQ ID NO: 126.

Embodiment 122

The composition of embodiment 69, wherein the second RNA binding protein comprises or consists of a Endonuclease III-like protein 1 (NTHL) polypeptide.

Embodiment 123

The composition of embodiment 122, wherein the NTHL polypeptide comprises or consists of SEQ ID NO: 123.

Embodiment 124

The composition of embodiment 69, wherein the second RNA binding protein comprises or consists of a Mitochondrial ribonuclease P catalytic subunit (KIAA0391) polypeptide.

Embodiment 125

The composition of embodiment 124, wherein the KIAA0391 polypeptide comprises or consists of SEQ ID NO: 127.

Embodiment 126

The composition of embodiment 69, wherein the second RNA binding protein comprises or consists of an apurinic or apyrimidinic site lyase (APEX1) polypeptide.

Embodiment 127

The composition of embodiment 126, wherein the APEX1 polypeptide comprises or consists of SEQ ID NO: 125.

Embodiment 128

The composition of embodiment 69, wherein the second RNA binding protein comprises or consists of an argonaute 2 (AGO2) polypeptide.

Embodiment 129

The composition of embodiment 128, wherein the AGO2 polypeptide comprises or consists of SEQ ID NO: 128.

Embodiment 130

The composition of embodiment 69, wherein the second RNA binding protein comprises or consists of a mitochondrial nuclease EXOG (EXOG) polypeptide.

Embodiment 131

The composition of embodiment 130, wherein the EXOG polypeptide comprises or consists of SEQ ID NO: 129.

Embodiment 132

The composition of embodiment 69, wherein the second RNA binding protein comprises or consists of a Zinc Finger CCCH-Type Containing 12D (ZC3H12D) polypeptide.

Embodiment 133

The composition of embodiment 132, wherein the ZC3H12D polypeptide comprises or consists of SEQ ID NO: 130.

Embodiment 134

The composition of embodiment 69, wherein the second RNA binding protein comprises or consists of an endoplasmic reticulum to nucleus signaling 2 (ERN2) polypeptide.

Embodiment 135

The composition of embodiment 134, wherein the ERN2 polypeptide comprises or consists of SEQ ID NO: 131.

Embodiment 136

The composition of embodiment 69, wherein the second RNA binding protein comprises or consists of a pelota mRNA surveillance and ribosome rescue factor (PELO) polypeptide.

Embodiment 137

The composition of embodiment 136, wherein the PELO polypeptide comprises or consists of SEQ ID NO: 132.

Embodiment 138

The composition of embodiment 69, wherein the second RNA binding protein comprises or consists of a YBEY metallopeptidase (YBEY) polypeptide.

Embodiment 139

The composition of embodiment 138, wherein the YBEY polypeptide comprises or consists of SEQ ID NO: 133.

Embodiment 140

The composition of embodiment 69, wherein the second RNA binding protein comprises or consists of a cleavage and polyadenylation specific factor 4 like (CPSF4L) polypeptide.

Embodiment 141

The composition of embodiment 140, wherein the CPSF4L comprises or consists of SEQ ID NO: 134.

Embodiment 142

The composition of embodiment 69, wherein the second RNA binding protein comprises or consists of an hCG_2002731 polypeptide.

Embodiment 143

The composition of embodiment 142, wherein the hCG_2002731 polypeptide comprises or consists of SEQ ID NO: 135.

Embodiment 144

The composition of embodiment 142, wherein the hCG_2002731 polypeptide comprises or consists of SEQ ID NO: 136.

Embodiment 145

The composition of embodiment 69, wherein the second RNA binding protein comprises or consists of an Excision Repair Cross-Complementation Group 1 (ERCC1) polypeptide.

Embodiment 146

The composition of embodiment 145, wherein the ERCC1 polypeptide comprises or consists of SEQ ID NO: 137.

Embodiment 147

The composition of embodiment 69, wherein the second RNA binding protein comprises or consists of a ras-related C3 botulinum toxin substrate 1 isoform (RAC1) polypeptide.

Embodiment 148

The composition of embodiment 147, wherein the RAC1 polypeptide comprises or consists of SEQ ID NO: 138.

Embodiment 149

The composition of embodiment 69, wherein the second RNA binding protein comprises or consists of a Ribonuclease A A1 (RAA1) polypeptide.

Embodiment 150

The composition of embodiment 149, wherein the RAA1 polypeptide comprises or consists of SEQ ID NO: 139.

Embodiment 151

The composition of embodiment 69, wherein the second RNA binding protein comprises or consists of a Ras Related Protein (RAB1) polypeptide.

Embodiment 152

The composition of embodiment 151, wherein the RAB1 polypeptide comprises or consists of SEQ ID NO: 140.

Embodiment 153

The composition of embodiment 69, wherein the second RNA binding protein comprises or consists of a DNA Replication Helicase/Nuclease 2 (DNA2) polypeptide.

Embodiment 154

The composition of embodiment 153, wherein the DNA2 polypeptide comprises or consists of SEQ ID NO: 141.

Embodiment 155

The composition of embodiment 69, wherein the second RNA binding protein comprises or consists of a FLJ35220 polypeptide.

Embodiment 156

The composition of embodiment 155, wherein the FLJ35220 polypeptide comprises or consists of SEQ ID NO: 142.

Embodiment 157

The composition of embodiment 69, wherein the second RNA binding protein comprises or consists of a FLJ13173 polypeptide.

Embodiment 158

The composition of embodiment 157, wherein the FLJ13173 polypeptide comprises or consists of: (SEQ ID NO: 143.

Embodiment 159

The composition of embodiment 69, wherein the second RNA binding protein comprises or consists of a DNA repair endonuclease XPF (ERCC4) polypeptide.

Embodiment 160

The composition of embodiment 159, wherein the ERCC4 polypeptide comprises or consists of SEQ ID NO: 64.

Embodiment 161

The composition of embodiment 69, wherein the second RNA binding protein comprises or consists of a mutated Rnase1 (Rnase1(K41R)) polypeptide.

Embodiment 162

The composition of embodiment 161, wherein the Rnase1 (K41R) polypeptide comprises or consists of SEQ ID NO: 116.

Embodiment 163

The composition of embodiment 69, wherein the second RNA binding protein comprises or consists of a mutated Rnase1 (Rnase1(K41R, D121E)) polypeptide.

Embodiment 164

The composition of embodiment 163, wherein the Rnase1 (Rnase1(K41R, D121E)) polypeptide comprises or consists of SEQ ID NO: 117.

Embodiment 165

The composition of embodiment 69, wherein the second RNA binding protein comprises or consists of a mutated Rnase1 (Rnase1(K41R, D121E, H119N)) polypeptide.

Embodiment 166

The composition of embodiment 165, wherein the Rnase1 (Rnase1(K41R, D121E, H119N)) polypeptide comprises or consists of SEQ ID NO: 118.

Embodiment 167

The composition of embodiment 69, wherein the second RNA binding protein comprises or consists of a mutated Rnase1 (Rnase1(H119N)) polypeptide.

Embodiment 168

The composition of embodiment 167, wherein the Rnase1 (Rnase1(H119N)) polypeptide comprises or consists of SEQ ID NO: 119.

Embodiment 169

The composition of embodiment 69, wherein the second RNA binding protein comprises or consists of a mutated Rnase1 (Rnase1(R39D, N67D, N88A, G89D, R91D, H119N)) polypeptide.

Embodiment 170

The composition of embodiment 169, wherein the Rnase1 (Rnase1(R39D, N67D, N88A, G89D, R91D, H119N)) polypeptide comprises or consists of SEQ ID NO: 120.

Embodiment 171

The composition of embodiment 69, wherein the second RNA binding protein comprises or consists of a mutated Rnase1 (Rnase1(R39D, N67D, N88A, G89D, R91D, H119N)) polypeptide.

Embodiment 172

The composition of embodiment 171, wherein the Rnase1 (Rnase1(R39D, N67D, N88A, G89D, R91D, H119N, K41R, D121E)) polypeptide comprises or consists of SEQ ID NO: 121.

Embodiment 173

The composition of embodiment 69, wherein the second RNA binding protein comprises or consists of a mutated Rnase1 (Rnase1(R39D, N67D, N88A, G89D, R91D, H119N)) polypeptide.

Embodiment 174

The composition of embodiment 173, wherein the Rnase1 (Rnase1(R39D, N67D, N88A, G89D, R91D)) polypeptide comprises or consists of SEQ ID NO: 122.

Embodiment 175

The composition of embodiment 69, wherein the second RNA binding protein comprises or consists of Teneurin Transmembrane Protein 1 (TENM1) polypeptide.

Embodiment 176

The composition of embodiment 175, wherein the TENM1 polypeptide comprises or consists of SEQ ID NO: 144.

Embodiment 177

The composition of embodiment 69, wherein the second RNA binding protein comprises or consists of Teneurin Transmembrane Protein 2 (TENM2) polypeptide.

Embodiment 178

The composition of embodiment 177, wherein the TENM2 polypeptide comprises or consists of SEQ ID NO: 145.

Embodiment 179

A composition comprising a sequence encoding a target RNA-binding fusion protein comprising (a) a sequence encoding a first RNA-binding polypeptide or portion thereof; and (b) a sequence encoding a second RNA-binding polypeptide, wherein the first RNA-biding polypeptide binds a target RNA not guided by a gRNA sequence, and wherein the second RNA-binding polypeptide comprises RNA-nuclease activity.

Embodiment 180

The composition of embodiment 179, wherein the first RNA-binding polypeptide or portion thereof is a PUF, PUMBY, or PPR polypeptide or portion thereof.

Embodiment 181

A method for modifying the level of expression of an RNA molecule or a protein encoded by the RNA molecule, the method comprising contacting the composition of embodiments 1 or 179 and the RNA molecule under conditions suitable for binding of the fusion protein or a portion thereof to the RNA molecule.

EXAMPLES

Example 1: Methods

HEK-293 cells were cultured in DMEM with 10% FBS and 1% penicillin/streptomycin (GIBCO) and passaged at 90%-100% confluency. Cells were seeded at $1\times10^5$ cells per well of a 24-well plate for RNA isolation or $0.5\times10^5$ cells per well of a 96-well plate for luciferase assays. RNA isolations were carried out with RNAeasy columns (Qiagen) according to the manufacturer's protocol. RNA quality and concentrations were estimated using the Nanodrop spectrophotometer. cDNA preparation was done using Superscript III (Thermo) with random primers according to the manufacturer's protocol. qPCR was carried out with primers in a sequence adjacent to the CTG repeat in the reporter plasmid using the following primers:

```
Forward Primer TetCTG_DMPK_E15_F
                                  SEQ ID NO: 83
TCGGAGCGGTTGTGAACT Reverse Primer TetCTG_DMPK_E15_R
                                  SEQ ID NO: 84
GTTCGCCGTTGTTCTGTC
```

Relative abundance of the CTG repeat reporter was determined by normalization to GAPDH. Next, levels of the CTG-targeting sgRNA were normalized to a non-targeting sgRNA to generate a final value reported in the associated data package.

```
CTG-targeting spacer
                                  SEQ ID NO: 85
AGCAGCAGCAGCAGCAGCAG Non-targeting control spacer (λ2)
                                  SEQ ID NO: 86
GTGATAAGTGGAATGCCATG sgRNA scaffold (N's indicate spacer)
                                  SEQ ID NO: 87
GNNNNNNNNNNNNNNNNNNNNNGUUUAAGAGCUAUGCUGGAAACAGCAUAG

CAAGUUUAAAUAAGGCUAGUCCGUUAUCAACUUGAAAAAGUGGCACCGAG

UCGGUGCUUUUUUU
```

Luciferase assays were conducted with the Promega Dual Luciferase kit according to manufacturer's directions. Reported values are a ratio of firefly and renilla luciferase luminescence readings.

Example 2: RNA-Guided Cleavage of Repetitive RNA Molecules and mRNA Molecules Experimental Design: Various fusions of human proteins with annotated RNA endonuclease activity and Cas9 (*Streptococcus pyogenes* or *Campylobacter jejuni*) were constructed. Plasmids encoding the above fusions were co-transfected with either a repeat-containing plasmid or a luciferase assay plasmid (comprising an mRNA sequence encoding a luciferase protein). A level of CTG repeat-containing RNA was measured with qPCR in the condition in which an RNA endonuclease/Cas9 fusion was co-transfected with a repetitive RNA. A level of luciferase protein was measured using a luminescence assay in the condition in which an RNA endonuclease/Cas9 fusion was co-transfected with a luciferase assay plasmid. All measurements were normalized to a non-targeting sgRNA control construct (FIGS. 3A-5 and FIG. 9).

Example 3: RNA-Guided Cleavage of Viral RNA Molecules

A549 cells were cultured in DMEM with 10% FBS and 1% penicillin/streptomycin (GIBCO) and passaged at 90%-100% confluency. Cells were seeded at $1 \times 10^5$ cells per well of a 24-well plate for RNA isolation or $0.5 \times 10^5$ cells per well. Cells were transfected with plasmids encoding *Campylobacter jejuni* Cas9 (CjeCas9) fused to the gene NTHL1 (residues 31-312, E43) or CPSF4L (full length, E67) with plasmids encoding one of four sites in Zika NS5 RNA. CjeCas9 was driven by an EFS promoter while the guide RNAs were driven by U6 promoter. The sequences of the sgRNAs are presented in Table 1. The sequences of the constructs used in this study are presented below.

RNA isolations were carried out with RNAeasy columns (Qiagen) according to the manufacturer's protocol. RNA quality and concentrations were estimated using the Nanodrop spectrophotometer. cDNA preparation was done using Superscript III (Thermo) with random primers according to the manufacturer's protocol. qPCR was carried out with the following primers as listed in Table 2.

Figure 7A:
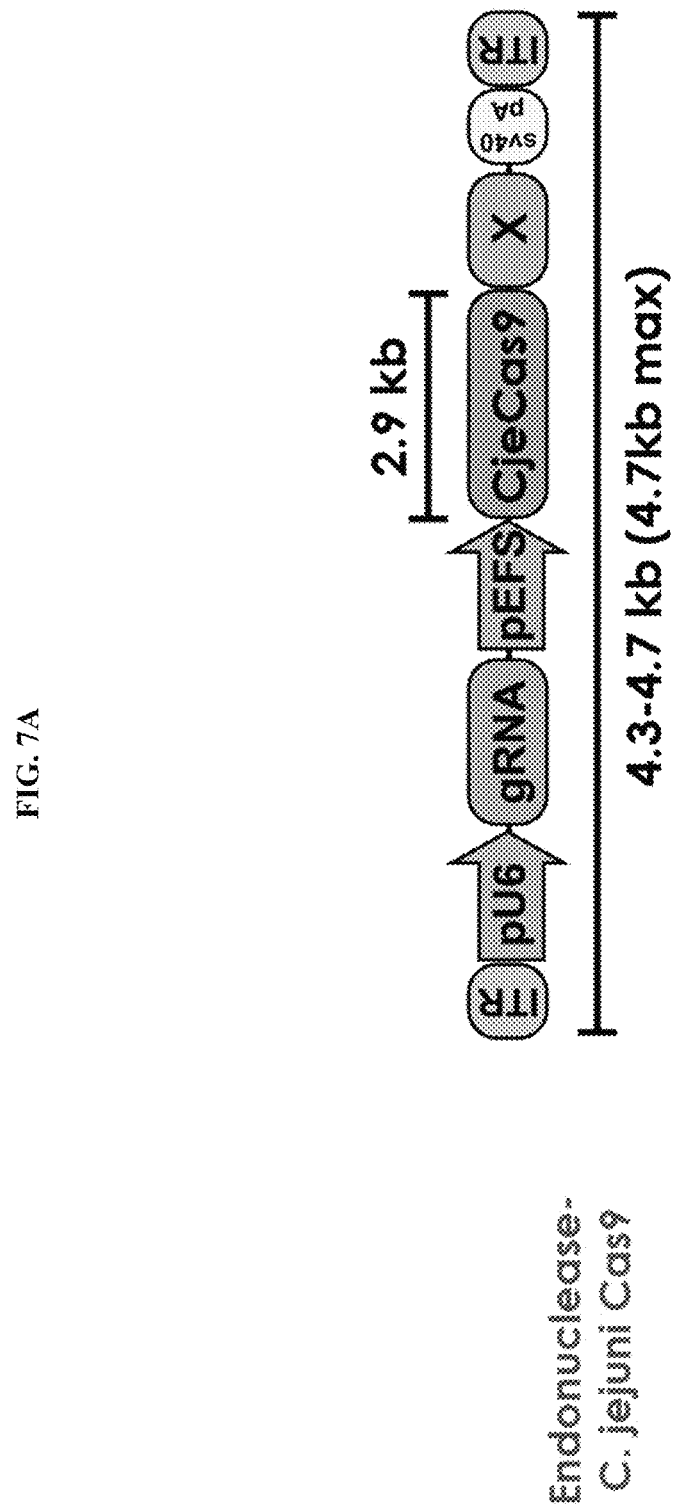
FIG. 7A is a schematic diagram depicting an exemplary RNA Endonuclease-*C. jejuni* Cas9 fusion protein.
Figure 7B:
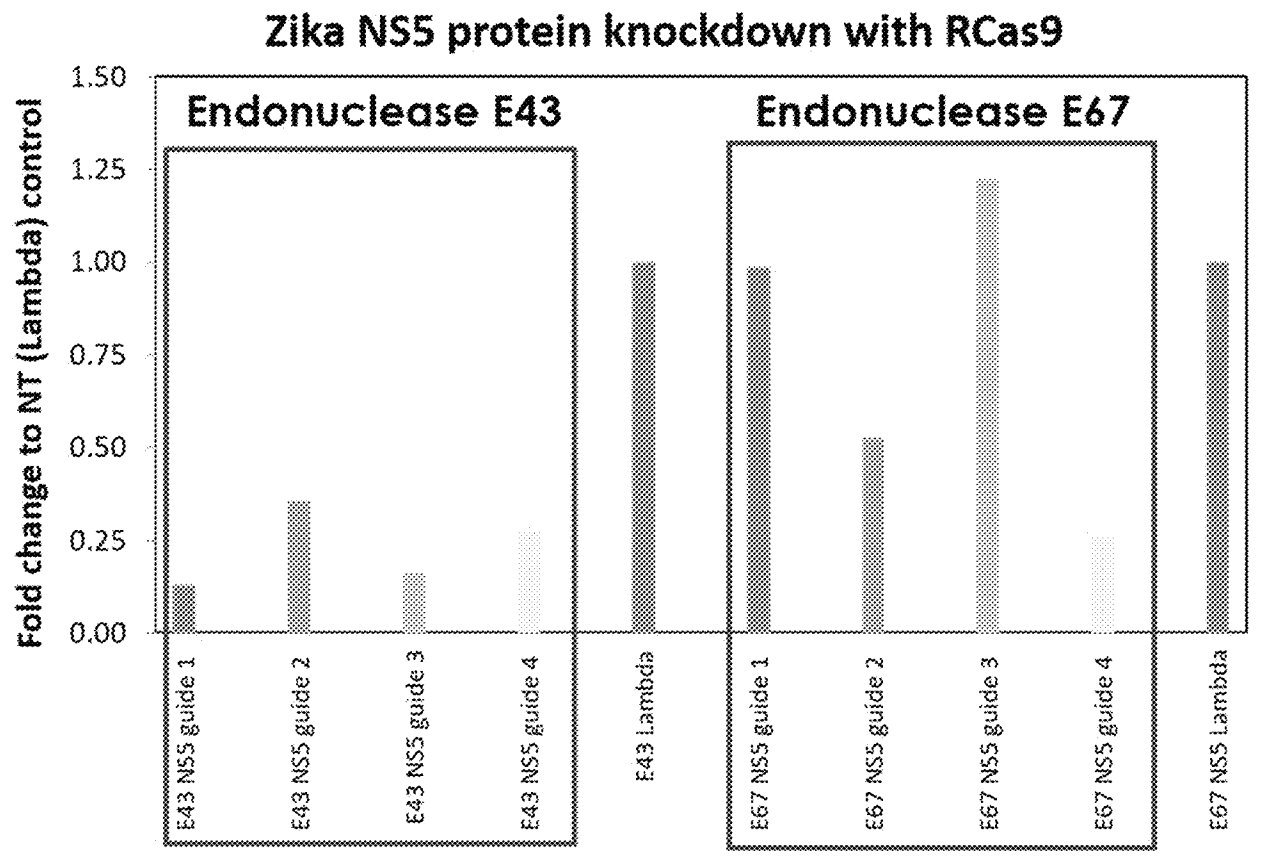

FIG. 7 shows expression levels of Zika NS5 assessed in the presence of both E43 and E67 endonucleases with sgRNAs containing the various NS5-targeting spacer sequences as indicated in Table 2. Zika NS5 expression is displayed as fold change relative to the endonuclease loaded with an sgRNA containing a control (Lambda) spacer sequence.

Figure 8A:
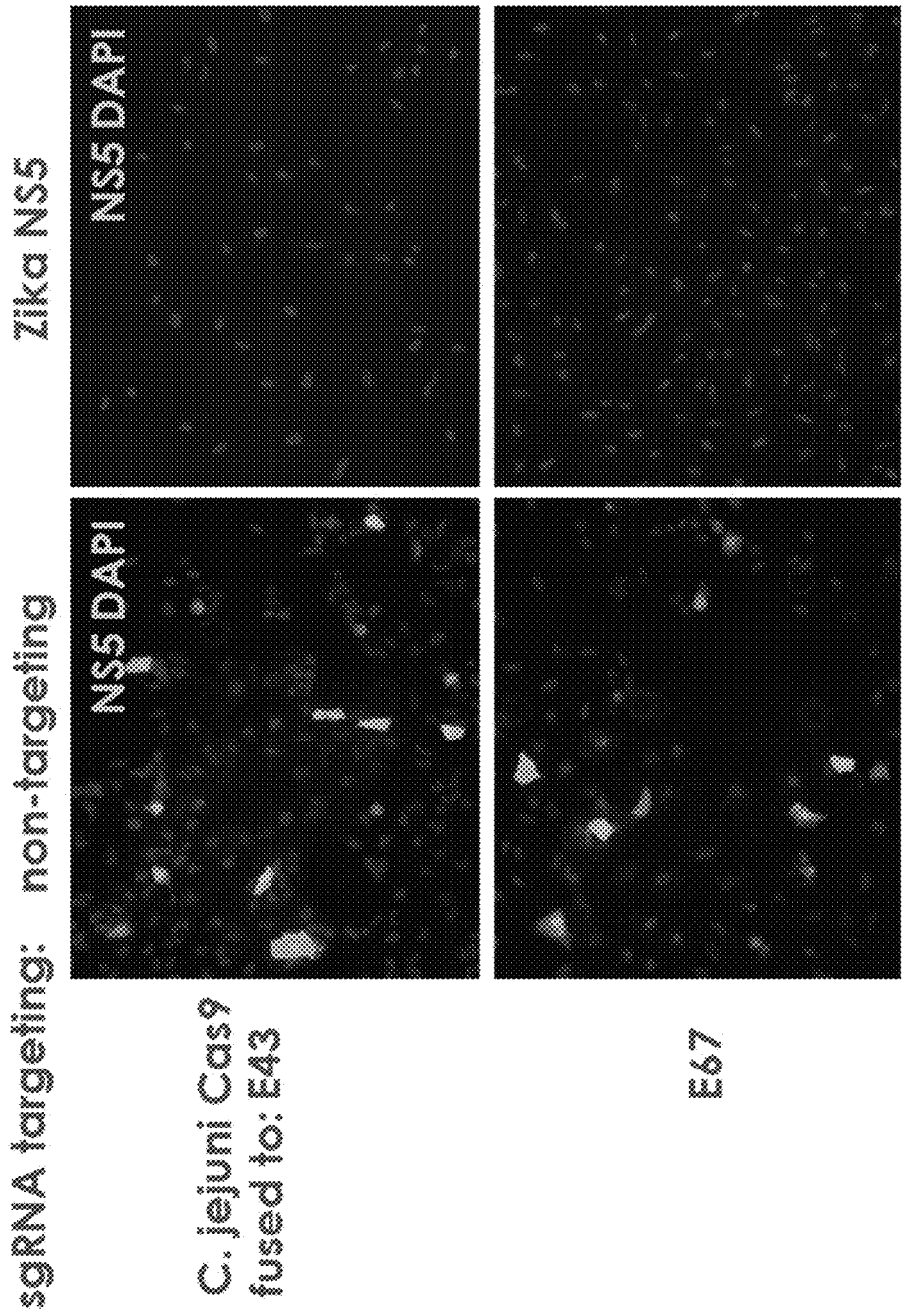
FIG. 8A is a fluorescence microscopy image of cells transfected with CjeCas9-endonuclease fusions loaded with an sgRNA containing a Zika NS5-targeting spacer sequence.
Figure 8B:
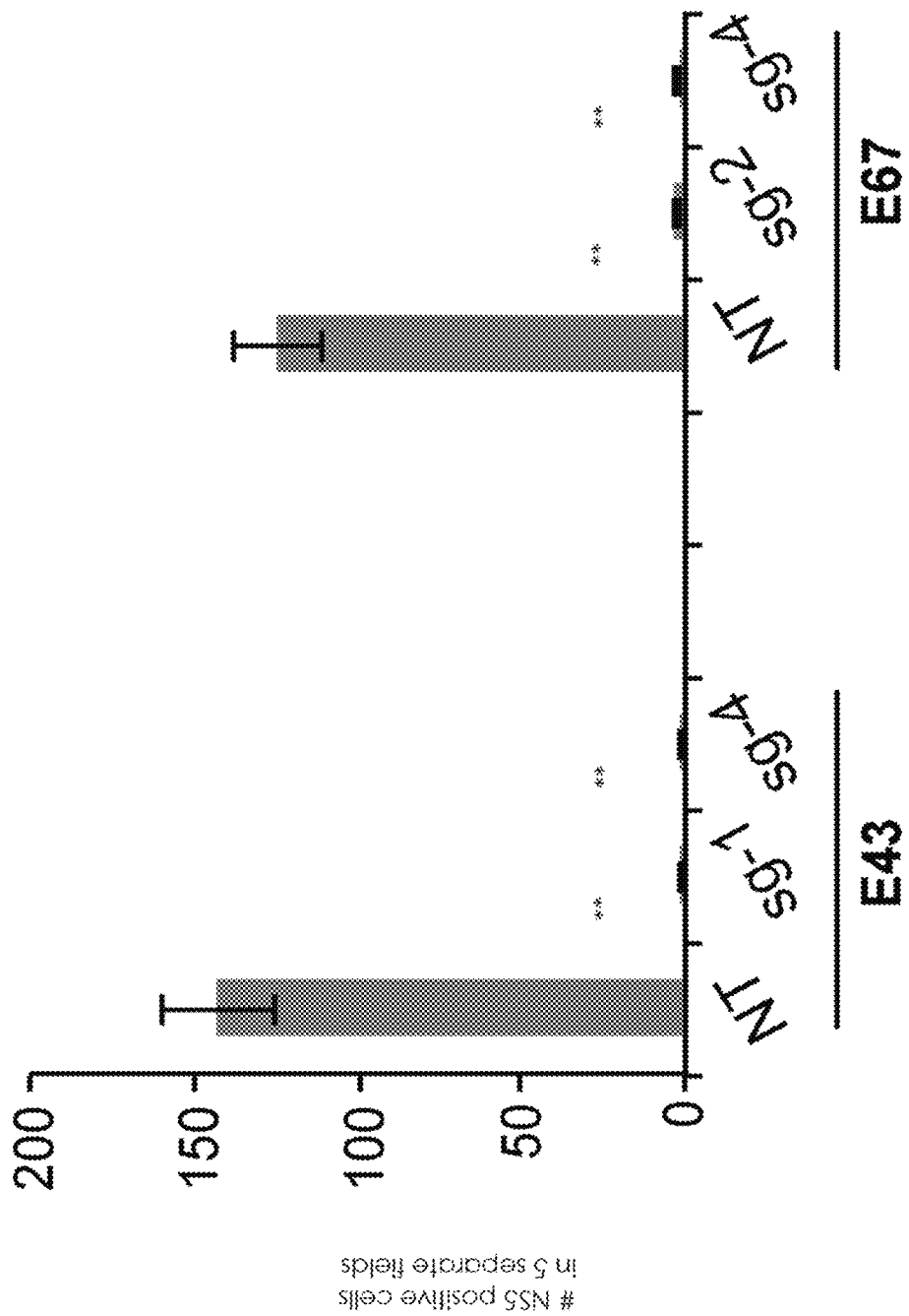
FIG. 8B is a graph depicting changes of expression of Zika NS5 in the presence of CjeCas9-endonuclease fusions loaded with the appropriate Zika NS5-targeting sgRNA as compared to a CjeCas9-endonuclease fusions loaded with a non-Zika NS5 targeting sgRNA.

Immunofluorescence microscopy was used to visualize Zika NS5 expression in the presence of E43 or E67 endonucleases fused to CjeCas9. FIG. 8A shows a fluorescence microscopy image of cells transfected with CjeCas9-endonuclease fusions loaded with an sgRNA containing a Zika NS5-targeting spacer sequence. Expression of Zika NS5 is markedly decreased in the presence of CjeCas9-endonuclease fusions loaded with the appropriate Zika NS5-targeting sgRNA as compared to CjeCas9-endonuclease fusions loaded with a non-Zika NS5 targeting sgRNA (FIGS. 8A and 8B). FIG. 6 is a list of exemplary endonucleases for use in the compositions of the disclosure.

TABLE 1

| qPCR primers | |
|---|---|
| GAPDH_F | CAGCCTCAAGATCATCAGCAA (SEQ ID NO: 192) |
| GAPDH_R | TGTGGTCATGAGTCCTTCCA (SEQ ID NO: 193) |
| NS5_F | GAGGAGAGTGCCAGAGTTGT (SEQ ID NO: 194) |
| NS5_R | TCTCTCTCCCCATCCAGTGA (SEQ ID NO: 195) |

TABLE 2

| sgRNA sequences | |
|---|---|
| NS5-targeting spacer 1 | gcaatgatcttcatgttgggagc (SEQ ID NO: 196) |
| NS5-targeting spacer 2 | gaaccttgttgatgaactcttc (SEQ ID NO: 197) |
| NS5-targeting spacer 3 | gttggtgattagagcttcattc (SEQ ID NO: 198) |
| NS5-targeting spacer 4 | gagtgatcctcgttcaagaatcc (SEQ ID NO: 199) |
| Non-targeting control spacer (λ2) | GTGATAAGTGGAATGCCATG (SEQ ID NO: 200) |
| sgRNA scaffold (N's indicate spacer) | GNNNNNNNNNNNNNNNNNNNNNGUUAAGAGCUAUGCUGGAAACAGCAUAGCAAGUUUAAAUAAGGCUAGUCCGUUAUCAACUUGAAAAAGUGGCACCGAGUCGGUGCUUUUUUU (SEQ ID NO: 201) |

A E43-CjeCas9 and sgRNA plasmid may comprise or consist of the sequence (U6: N's=sgRNA spacer, E43, CjeCas9):

(SEQ ID NO: 202)

gtttattacagggacagcagagatccagtttggttaattaaggtaccgag ggcctatttcccatgattccttcatatttgcatatacgatacaaggctgt tagagagataattagaattaatttgactgtaaacacaaagatattagtac aaaatacgtgacgtagaaagtaataatttcttgggtagtttgcagtttta aaattatgttttaaaatggactatcatatgcttaccgtaacttgaaagta tttcgatttcttggctttatatatcttGTGGAAAGGACGAAACACCNNNN

NNNNNNNNNNNNNNNNGTTTTAGTCCCTGAAGGGACTAAAATAAAGAGTTT

GCGGGACTCTGCGGGGTTACAATCCCCTAAAACCGCTTTTTTTCCTGCAG

CCCGGGGGATCCACTAGTTCTAGAGCGGCCGCCACCGCGGTGGAGCTCCA

GCTTTTGTTCCCTTTAGTGAGGGTTAATTGCGCGAATTCGCTAGCTAGGT

CTTGAAAGGAGTGGGAATTGGCTCCGGTGCCCGTCAGTGGGCAGAGCGCA

CATCGCCCACAGTCCCCGAGAAGTTGGGGGGAGGGGTCGGCAATTGATCC

GGTGCCTAGAGAAGGTGGCGCGGGGTAAACTGGGAAAGTGATGTCGTGTA

CTGGCTCCGCCTTTTTCCCGAGGGTGGGGGAGAACCGTATATAAGTGCAG

TAGTCGCCGTGAACGTTCTTTTTCGCAACGGGTTTGCCGCCAGAACACAG

GACCGGTTCTAGAGCGCTATTTAGAACCatgTGTTCTCCCCAAGAATCTG

GCATGACCGCTCTTTCAGCGAGGATGTTGACGCGAAGCAGATCCCTGGGA

CCTGGGGCCGGGCCACGAGGGTGTCGGGAAGAACCAGGACCGTTGCGACG

GAGGGAAGCAGCAGCGGAAGCTCGGAAATCCCATTCTCCGGTTAAACGAC

CCCGCAAGGCACAACGGCTCAGGGTTGCTTACGAGGGAGCGATTCCGAA

AAGGGTGAAGGAGCAGAGCCCTTGAAGGTTCCAGTATGGGAACCCCAGGA

TTGGCAGCAGCAGCTTGTAAACATCCGAGCAATGAGGAACAAAAAAGATG

CACCTGTTGATCACCTCGGAACCGAACATTGTTATGATTCTAGTGCGCCG

CCAAAAGTCCGCCGGTATCAGGTTCTGTTGAGTTTGATGCTGAGTAGTCA

GACTAAGGACCAGGTTACGGCCGGAGCAATGCAACGGCTTCGGGCACGGG

GACTCACGGTCGATAGCATTTTGCAGACCGATGACGCAACATTGGGTAAA

CTCATATATCCAGTTGGCTTCTGGCGGAGCAAAGTGAAGTACATCAAGCA

GACCTCAGCCATTCTCCAACAACATTACGGAGGTGATATACCCGCAAGCG

TAGCTGAACTGGTAGCACTGCCGGGCGTCGGTCCCAAAATGGCACATCTG

GCTATGGCGGTTGCTTGGGGAACGGTGTCTGGTATCGCAGTTGATACGCA

TGTCCACCGCATCGCCAATCGGCTGAGGTGGACTAAAAAAGCCACTAAGT

CTCCTGAAGAAACACGGGCTGCTCTGGAAGAGTGGCTTCCACGAGAGCTG

TGGCATGAAATCAATGGATTGCTGGTTGGTTTCGGGCAGCAGACATGCTT

GCCCGTGCACCCCCGGTGTCATGCTTGCTTGAACCAGGCTTTGTGCCCAG

CTGCCCAGGGCCTGAGTGGAAGTGAGACACCGGGAACATCTGAGTCTGCG

ACCCCGGAGAGCacaaacGCGCGAATCCTGGCCTTCGcgATTGGCATTAG

CAGCATCGGCTGGGCATTCTCTGAAAACGACGAACTGAAGGATTGCGGCG

TGCGAATTTTCACTAAGGTCGAAAATCCCAAAACTGGTGAATCACTCGCT

CTCCCTAGACGACTGGCACGCTCCGCACGAAAGAGGCTTGCCCGCCGCAA

GGCACGCTTGAACCATCTTAAACACCTTATTGCAAATGAGTTTAAACTGA

ATTATGAGGACTACCAATCCTTTGACGAGTCTCTTGCTAAAGCCTACAAA

GGGAGCCTTATATCCCCGTATGAGCTCCGGTTCAGAGCACTCAACGAACT

GCTGTCCAAACAGGATTTTGCTCGCGTGATTCTCCACATAGCGAAGAGGC

GAGGATACGATGACATTAAAAACAGTGATGATAAGGAAAAAGGGGCCATA

CTCAAAGCGATTAAGCAAAATGAAGAGAAGCTCGCTAACTATCAATCAGT

AGGGGAGTATCTCTATAAAGAGTACTTCCAGAAGTTCAAAGAAAATAGCA

AGGAATTTACTAATGTCCGGAATAAAAAGGAGTCTTACGAAAGATGTATT

GCGCAATCTTTCCTCAAGGACGAGCTCAAATTGATTTTCAAGAAACAAAG

GGAATTTGGGTTCAGCTTCTCAAAAAAATTTGAGGAAGAGGTTCTGAGCG

TTGCCTTTTACAAACGCGCCCTTAAGGACTTCTCACATCTCGTAGGGAAT

TGTAGTTTCTTCACCGATGAAAAACGGGCGCCAAAAAATAGCCCTTTGGC

TTTTATGTTTGTCGCTCTGACTCGCATCATTAATCTGCTCAACAACCTTA

AAAACACGGAAGGGATTCTGTACACAAAGGATGATCTGAACGCTCTGCTT

AACGAAGTTTTGAAGAACGGGACTTTGACCTACAAACAAACCAAAAAGCT

TCTTGGTCTCAGTGATGACTACGAATTCAAGGGAGAAAAAGGGACATATT

TCATCGAATTCAAGAAGTATAAGGAGTTCATCAAAGCCTTGGGCGAGCAC

AACTTGTCTCAAGATGATCTCAACGAAATTGCTAAGGATATCACTCTGAT

TAAAGACGAGATCAAGCTCAAAAAGGCGTTGGCGAAGTATGACCTTAACC

AAAACCAAATAGATAGCCTCAGCAAGTTGGAATTTAAAGATCACTTGAAT

ATAAGTTTCAAGGCCCTTAAGTTGGTCACCCCCTTGATGCTTGAAGGAAA

GAAATATGATGAGGCATGTAATGAGCTGAATCTCAAGGTTGCTATTAACG

AAGACAAAAAAGATTTCCTCCCAGCTTTCAATGAGACTTACTATAAGGAC

GAGGTTACCAATCCTGTGGTGCTCCGAGCCATCAAAGAGTATCGAAAGGT

CCTGAATGCTTTGCTCAAAAAATACGGTAAGGTACACAAAATAAATATTG

AGCTCGCAAGGGAGGTCGGTAAGAACCACTCCCAGCGCGCCAAAATAGAA

AAGGAACAGAATGAAAATTACAAAGCGAAAAAGGACGCCGAGCTCGAGTG

CGAAAAGCTGGGCCTGAAAATAAACAGCAAGAACATTCTCAAACTCCGCC

TCTTCAAAGAACAAAAAGAATTTTGTGCTTATAGTGGTGAGAAAATAAAA

ATCTCCGATCTTCAAGACGAGAAGATGCTCGAAATAGACgcgATATATCC

ATATAGCAGGTCTTTTGACGATTCTTACATGAATAAAGTGCTTGTTTTCA

CTAAGCAGAATCAGGAAAAGTTGAATCAGACCCCCTTTGAGGCCTTTGGC

AACGACTCAGCAAAGTGGCAGAAGATCGAGGTCTTGGCTAAGAATCTTCC

TACTAAGAAACAGAAAAGGATATTGGATAAGAACTATAAAGACAAAGAAC

AAAAGAACTTTAAAGACCGCAACCTCAATGACACCAGATACATAGCAAGA

TTGGTTCTGAACTACACAAAAGATTATTTGGACTTCTTGCCGCTGTCTGA

TGATGAGAACACGAAACTCAACGACACGCAAAAGGGGTCTAAAGTCCACG

TCGAAGCTAAATCTGGGATGCTCACCTCAGCATTGAGGCATACGTGGGGA

TTCTCAGCAAAGGACCGAAACAATCACCTGCACCATGCCATTGACGCAGT

TATCATAGCGTATGCCAATAATTCAATAGTAAAAGCGTTTAGCGACTTCA
AGAAGGAACAAGAGTCCAACAGCGCCGAGCTCTACGCAAAAAAGATTAGT
GAACTCGACTACAAAAACAAAAGAAAATTCTTTGAGCCGTTCAGCGGATT
TCGACAGAAGGTATTGGATAAAATAGATGAAATTTTCGTGAGCAAACCCG
AAAGGAAAAAGCCCTCAGGCGCCTTGCACGAAGAGACTTTCAGGAAGGAA
GAGGAATTCTACCAAAGCTACGGCGGAAAAGAGGGAGTTTTGAAGGCTCT
CGAACTTGGAAAGATTAGGAAGGTGAACGGCAAGATAGTGAAAAACGGCG
ATATGTTCCGGGTTGATATCTTCAAACATAAAAAAACGAATAAATTTTAT
GCTGTGCCTATATACACTATGGACTTCGCACTTAAGGTCCTGCCGAATAA
GGCGGTAGCCCGATCTAAAAAAGGCGAAATTAAGGACTGGATTTTGATGG
ATGAAAATTACGAGTTCTGCTTTTCTCTACAAGGATTCCCTTATATTG
ATACAGACGAAAGATATGCAGGAACCGGAATTCGTGTATTACAACGCTTT
TACTTCCTCTACGGTATCTTTGATTGTCTCCAAACATGACAACAAATTCG
AAACACTCAGTAAAAACCAAAAGATTCTCTTTAAAAATGCGAACGAGAAA
GAAGTAATTGCAAAATCAATTGGCATCCAAAATTTGAAAGTTTTTGAAAA
ATATATAGTATCTGCCCTCGGAGAGGTTACTAAAGCGGAATTTAGACAGC
GAGAGGACTTCAAAAAATCAGGTCCACCCAAGAAAAAACGCAAGGTGGAA
GATCCGAAGAAAAAGCGAAAGTGGATGTGtaaCGTTTTCCGGGACGCCG
GCTGGATGATCCTCCAGCGCGGGATCTCATGCTGGAGTTCTTCGCCCAC
CCCAACTTGTTTATTGCAGCTTATAATGGTTACAAATAAAGCAATAGCAT
CACAAATTTCACAAATAAAGCATTTTTTTCACTGCATTCTAGTTGTGGTT
TGTCCAAACTCATCAATGTATCTTATCATGTCTGTATACCG.

A E67-CjeCas9 and sgRNA plasmid may comprise or consist of the sequence (U6: N's=sgRNA spacer, E67, CieCas9):

(SEQ ID NO: 203)
gtttattacagggacagcagagatccagtttggttaattaaggtaccgag
ggcctatttccatgattccttcatatttgcatatacgatacaaggctgt
tagagagataattagaattaatttgactgtaaacacaaagatattagtac
aaaatacgtgacgtagaaagtaataatttcttgggtagtttgcagtttta
aaattatgttttaaaatggactatcatatgcttaccgtaacttgaaagta
tttcgatttcttggctttatatatcttGTGGAAAGGACGAAACACCNNNN
NNNNNNNNNNNNNGTTTTAGTCCCTGAAGGGACTAAAATAAAGAGTTT
GCGGGACTCTGCGGGGTTACAATCCCCTAAAACCGCTTTTTTTCCTGCAG
CCCGGGGGATCCACTAGTTCTAGAGCGGCCGCCACCGCGGTGGAGCTCCA
GCTTTTGTTCCCTTTAGTGAGGGTTAATTGCGCGAATTCGCTAGCTAGGT
CTTGAAAGGAGTGGGAATTGGCTCCGGTGCCCGTCAGTGGGCAGAGCGCA
CATCGCCCACAGTCCCCGAGAAGTTGGGGGGAGGGGTCGGCAATTGATCC
GGTGCCTAGAGAAGGTGGCGCGGGGTAAACTGGGAAAGTGATGTCGTGTA
CTGGCTCCGCCTTTTTCCCGAGGGTGGGGGAGAACCGTATATAAGTGCAG
TAGTCGCCGTGAACGTTCTTTTTCGCAACGGGTTTGCCGCCAGAACACAG GACCGGTTCTAGAGCGCTATTTAGAACCatgCAGGAGGTAATAGCGGGGC
TTGAGCGATTTACCTTTGCCTTCGAAAAAGACGTAGAGATGCAGAAGGGA
ACCGGCCTGCTCCCATTTCAAGGTATGGACAAATCAGCATCTGCCGTGTG
CAATTTTTTCACCAAGGGTCTGTGTGAAAAGGGGAAGCTCTGTCCATTTC
GCCATGATCGCGGAGAGAAGATGGTGGTGTGTAAGCACTGGCTGAGAGGG
CTTTGCAAAAAAGGCGACCACTGCAAATTTCTTCACCAATATGACCTGAC
TCGAATGCCTGAGTGTTATTTTTACAGTAAGTTCGGTGACTGTAGCAACA
AAGAATGCAGCTTCTTGCATGTCAAACCAGCATTCAAGTCACAGGATTGC
CCGTGGTACGATCAGGGTTTTTGCAAGGACGGTCCCCTCTGCAAATATCG
ACACGTACCCAGAATTATGTGCCTTAATTACCTGGTCGGCTTCTGTCCTG
AAGGGCCAAAATGTCAGTTTGCTCAAAAAATTCGCGAGTTCAAATTGCTC
CCTGGGTCTAAAATTTGGGAACCCCAGGATTGGCAGCAGCAGCTTGTAAA
CATCCGAGCAATGAGGAACAAAAAAGATGCACCTGTTGATCACCTCGGAA
CCGAACATTGTTATGATTCTAGTGCGCCGCCAAAAGTCCGCCGGTATCAG
GTTCTGTTGAGTTTGATGCTGAGTAGTCAGACTAAGGACCAGGTTACGGC
CGGAGCAATGCAACGGCTTCGGGCACGGGGACTCACGGTCGATAGCATTT
TGCAGACCGATGACGCAACATTGGGTAAACTCATATATCCAGTTGGCTTC
TGGCGGAGCAAAGTGAAGTACATCAAGCAGACCTCAGCCATTCTCCAACA
ACATTACGGAGGTGATATACCCGCAAGCGTAGCTGAACTGGTAGCACTGC
CGGGCGTCGGTCCCAAAATGGCACATCTGGCTATGGCGGTTGCTTGGGGA
ACGGTGTCTGGTATCGCAGTTGATACGCATGTCCACCGCATCGCCAATCG
GCTGAGGTGGACTAAAAAAGCCACTAAGTCTCCTGAAGAAACACGGGCTG
CTCTGGAAGAGTGGCTTCCACGAGAGCTGTGGCATGAAATCAATGGATTG
CTGGTTGGTTTCGGGCAGCAGACATGCTTGCCCGTGCACCCCCGGTGTCA
TGCTTGCTTGAACCAGGCTTTGTGCCCAGCTGCCCAGGGCCTGAGTGGAA
GTGAGACACCGGGAACATCTGAGTCTGCGACCCCGGAGAGCacaaacGCG
CGAATCCTGGCCTTCGcgATTGGCATTAGCAGCATCGGCTGGGCATTCTC
TGAAAACGACGAACTGAAGGATTGCGGCGTGCGAATTTTCACTAAGGTCG
AAAATCCCAAAACTGGTGAATCACTCGCTCTCCCTAGACGACTGGCACGC
TCCGCACGAAAGAGGCTTGCCCGCCGCAAGGCACGCTTGAACCATCTTAA
ACACCTTATTGCAAATGAGTTTAAACTGAATTATGAGGACTACCAATCCT
TTGACGAGTCTCTTGCTAAAGCCTACAAAGGGAGCCTTATATCCCCGTAT
GAGCTCCGGTTCAGAGCACTCAACGAACTGCTGTCCAAACAGGATTTTGC
TCGCGTGATTCTCCACATAGCGAAGAGGCGAGGATACGATGACATTAAAA
ACAGTGATGATAAGGAAAAAGGGGCCATACTCAAAGCGATTAAGCAAAAT
GAAGAGAAGCTCGCTAACTATCAATCAGTAGGGGAGTATCTCTATAAAGA
GTACTTCCAGAAGTTCAAAGAAAATAGCAAGGAATTTACTAATGTCCGGA
ATAAAAAGGAGTCTTACGAAAGATGTATTGCGCAATCTTTCCTCAAGGAC
GAGCTCAAATTGATTTTCAAGAAACAAAGGGAATTTGGGTTCAGCTTCTC
AAAAAAATTTGAGGAAGAGGTTCTGAGCGTTGCCTTTTACAAACGCGCCC
TTAAGGACTTCTCACATCTCGTAGGGAATTGTAGTTTCTTCACCGATGAA

AAACGGGCGCCAAAAAATAGCCCTTTGGCTTTTATGTTTGTCGCTCTGAC

TCGCATCATTAATCTGCTCAACAACCTTAAAAACACGGAAGGGATTCTGT

ACACAAAGGATGATCTGAACGCTCTGCTTAACGAAGTTTTGAAGAACGGG

ACTTTGACCTACAAACAAACCAAAAAGCTTCTTGGTCTCAGTGATGACTA

CGAATTCAAGGGAGAAAAAGGGACATATTTCATCGAATTCAAGAAGTATA

AGGAGTTCATCAAAGCCTTGGGCGAGCACAACTTGTCTCAAGATGATCTC

AACGAAATTGCTAAGGATATCACTCTGATTAAAGACGAGATCAAGCTCAA

AAAGGCGTTGGCGAAGTATGACCTTAACCAAAACCAAATAGATAGCCTCA

GCAAGTTGGAATTTAAAGATCACTTGAATATAAGTTTCAAGGCCCTTAAG

TTGGTCACCCCCTTGATGCTTGAAGGAAAGAAATATGATGAGGCATGTAA

TGAGCTGAATCTCAAGGTTGCTATTAACGAAGACAAAAAAGATTTCCTCC

CAGCTTTCAATGAGACTTACTATAAGGACGAGGTTACCAATCCTGTGGTG

CTCCGAGCCATCAAAGAGTATCGAAAGGTCCTGAATGCTTTGCTCAAAAA

ATACGGTAAGGTACACAAAATAAATATTGAGCTCGCAAGGGAGGTCGGTA

AGAACCACTCCCAGCGCGCCAAAATAGAAAAGGAACAGAATGAAAATTAC

AAAGCGAAAAAGGACGCCGAGCTCGAGTGCGAAAAGCTGGGCCTGAAAAT

AAACAGCAAGAACATTCTCAAACTCCGCCTCTTCAAAGAACAAAAAGAAT

TTTGTGCTTATAGTGGTGAGAAAATAAAAATCTCCGATCTTCAAGACGAG

AAGATGCTCGAAATAGACgcgATATATCCATATAGCAGGTCTTTTGACGA

TTCTTACATGAATAAAGTGCTTGTTTTCACTAAGCAGAATCAGGAAAAGT

TGAATCAGACCCCCTTTGAGGCCTTTGGCAACGACTCAGCAAAGTGGCAG

AAGATCGAGGTCTTGGCTAAGAATCTTCCTACTAAGAAACAGAAAAGGAT

ATTGGATAAGAACTATAAAGACAAAGAACAAAAGAACTTTAAAGACCGCA

ACCTCAATGACACCAGATACATAGCAAGATTGGTTCTGAACTACACAAAA

GATTATTTGGACTTCTTGCCGCTGTCTGATGATGAGAACACGAAACTCAA

CGACACGCAAAAGGGGTCTAAAGTCCACGTCGAAGCTAAATCTGGGATGC

TCACCTCAGCATTGAGGCATACGTGGGGATTCTCAGCAAAGGACCGAAAC

AATCACCTGCACCATGCCATTGACGCAGTTATCATAGCGTATGCCAATAA

TTCAATAGTAAAAGCGTTTAGCGACTTCAAGAAGGAACAAGAGTCCAACA

GCGCCGAGCTCTACGCAAAAAAGATTAGTGAACTCGACTACAAAAACAAA

AGAAAATTCTTTGAGCCGTTCAGCGGATTTCGACAGAAGGTATTGGATAA

AATAGATGAAATTTTCGTGAGCAAACCCGAAAGGAAAAAGCCCTCAGGCG

CCTTGCACGAAGAGACTTTCAGGAAGGAAGAGGAATTCTACCAAAGCTAC

GGCGGAAAAGAGGGAGTTTTGAAGGCTCTCGAACTTGGAAAGATTAGGAA

GGTGAACGGCAAGATAGTGAAAAACGGCGATATGTTCCGGGTTGATATCT

TCAAACATAAAAAAACGAATAAATTTTATGCTGTGCCTATATACACTATG

GACTTCGCACTTAAGGTCCTGCCGAATAAGGCGGTAGCCCGATCTAAAAA

AGGCGAAATTAAGGACTGGATTTTGATGGATGAAAATTACGAGTTCTGCT

TTTCTCTCTACAAGGATTCCCTTATATTGATACAGACGAAAGATATGCAG

GAACCGGAATTCGTGTATTACAACGCTTTTACTTCCTCTACGGTATCTTT

GATTGTCTCCAAACATGACAACAAATTCGAAACACTCAGTAAAAACCAAA

AGATTCTCTTTAAAAATGCGAACGAGAAAGAAGTAATTGCAAAATCAATT

GGCATCCAAAATTTGAAAGTTTTTGAAAAATATATAGTATCTGCCCTCGG

AGAGGTTACTAAAGCGGAATTTAGACAGCGAGAGGACTTCAAAAAATCAG

GTCCACCCAAGAAAAAACGCAAGGTGGAAGATCCGAAGAAAAAGCGAAAA

GTGGATGTGtaaCGTTTTCCGGGACGCCGGCTGGATGATCCTCCAGCGCG

GGGATCTCATGCTGGAGTTCTTCGCCCACCCCAACTTGTTTATTGCAGCT

TATAATGGTTACAAATAAAGCAATAGCATCACAAATTTCACAAATAAAGC

ATTTTTTTCACTGCATTCTAGTTGTGGTTTGTCCAAACTCATCAATGTAT

CTTATCATGTCTGTATACCG.

INCORPORATION BY REFERENCE

Every document cited herein, including any cross referenced or related patent or application is hereby incorporated herein by reference in its entirety unless expressly excluded or otherwise limited. The citation of any document is not an admission that it is prior art with respect to any invention disclosed or embodimented herein or that it alone, or in any combination with any other reference or references, teaches, suggests or discloses any such invention. Further, to the extent that any meaning or definition of a term in this document conflicts with any meaning or definition of the same term in a document incorporated by reference, the meaning or definition assigned to that term in this document shall govern.

OTHER EMBODIMENTS

While particular embodiments of the disclosure have been illustrated and described, various other changes and modifications can be made without departing from the spirit and scope of the disclosure. The scope of the appended claims includes all such changes and modifications that are within the scope of this disclosure.

SEQUENCE LISTING (216 sequences)

SEQ ID NO: 1 - RNA, 20 nt, Artificial Sequence
  Space Sequence
uggagcgagcaucccccaaa

SEQ ID NO: 2 - RNA, 21 nt, Artificial Sequence
  Space Sequence
guuugggggaugcucgcucca

SEQ ID NO: 3 - RNA, 20 nt, Artificial Sequence
  Space Sequence
cccucacugcuggggagucc

SEQ ID NO: 4 - RNA, 20 nt, Artificial Sequence
  Space Sequence
ggacuccccagcagugaggg

SEQ ID NO: 5 - RNA, 20 nt, Artificial Sequence
  Space Sequence
gcaacuggaucaauuugcug

SEQ ID NO: 6 - RNA, 21 nt, Artificial Sequence
  Space Sequence
gcagcaaauugauccaguugc

SEQ ID NO: 7 - RNA, 21 nt, Artificial Sequence
  Space Sequence
gcauucuuaucuggucagugc

SEQ ID NO: 8 - RNA, 20 nt, Artificial Sequence
  Space Sequence
gcacugaccagauaagaaug

SEQ ID NO: 9 - RNA, 21 nt, Artificial Sequence
  Space Sequence
gagcagcagcagcagcagcag

SEQ ID NO: 10 - RNA, 21 nt, Artificial Sequence
  Space Sequence
gcaggcaggcaggcaggcagg

SEQ ID NO: 11 - RNA, 20 nt, Artificial Sequence
  Space Sequence
gccccggccccggccccggc

SEQ ID NO: 12 - DNA, 20 bp, Artificial Sequence
  Space Sequence
gctgctgctgctgctgctgc

SEQ ID NO: 13 - RNA, 93 nt, Artificial Sequence
  Scaffold Sequence
guuuaagagcuaugcuggaaacagcauagcaaguuuaaauaaggcuaguccguuaucaacuugaaaaaguggcaccgagucggugcuuuuuuu

SEQ ID NO: 14 - RNA, 20 nt, Artificial Sequence
  Space Sequence
gugauaaguggaaugccaug

SEQ ID NO: 15 - RNA, 20 nt, Artificial Sequence
  Space Sequence
cuggugaacuuccgauagug

SEQ ID NO: 16 - DNA, 20 bp, Artificial Sequence
  Space Sequence
gagatatagcctggtggttc

SEQ ID NO: 17 - RNA, 73 nt, Artificial Sequence
  Scaffold Sequence
ggacagcauagcaaguuaaaauaaggcuaguccguuaucaacuugaaaaaguggcaccgagucggugcuuuuu

SEQ ID NO: 18 - RNA, 3 nt, Artificial Sequence
  Space Sequence
cug

SEQ ID NO: 19 - RNA, 4 nt, Artificial Sequence
  Space Sequence
ccug

SEQ ID NO: 20 - protein, 128 aa, Unknown
  RNAse1
KESRAKKFQRQHMDSDSSPSSSSTYCNQMMRRRNMTQGLCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 21 - protein, 119 aa, Unknown
  RNAse4
QDGMYQRFLRQHVHPEETGGSDRYCDLMMQRRKMTLYHCKRFNTFIHEDIWNIRSICSTTNIQCKNGKMNCHEGVVKVTDCRDTGSSRAPNCRYRAIASTRRVVIACEGNPQVPVHFDG

SEQ ID NO: 22 - protein, 127 aa, Unknown
  RNAse6
WPKRLTKAHWFEIQHIQPSPLQCNRAMSGINNYTQHCKHQNTFLHDSFQNVAAVCDLLSIVCKNRRHNCHQSSKPVNMTDCRLTSGKYPQCRYSAAAQYKFFIVACDPPQKSDPPYKLVPVHLDSIL

SEQ ID NO: 23 - protein, 155 aa, Unknown
  RNAse7
APARAGFCPLLLLLLLGLWVAEIPVSAKPKGMTSSQWFKIQHMQPSPQACNSAMKNINKHTKRCKDLNTFLHEPFSSVAATCQTPKIACKNGDKNCHQSHGPVSLTMCKLTSGKYPNCRYKEKRQNKSYVVACKPPQKKDSQQFHLVPVHLDRVL

SEQ ID NO: 24 - protein, 122 aa, Unknown
  RNAse8
TSSQWFKTQHVQPSPQACNSAMSIINKYTERCKDLNTFLHEPFSSVAITCQTPNIACKNSCKNCHQSHGPMSLTMGELTSGKYPNCRYKEKHLNTPYIVACDPPQQGDPGYPLVPVHLDKVV

SEQ ID NO: 25 - protein, 134 aa, Unknown
  RNAse2
KPPQFTWAQWFETQHINMTSQQCTNAMQVINNYQRRCKNQNTFLLTTFANVVNVCGNPNMTCPSNKTRKNCHHSGSQVPLIHCNLTTPSPQNISNCRYAQTPANMFYIVACDNRDQRRDPPQYPVVPVHLDRII

SEQ ID NO: 26 - protein, 216 aa, Unknown
  RNAse6PL
DKRLRDNHEWKKLIMVQHWPETVCEKIQNDCRDPPDYWTIHGLWPDKSEGCNRSWPFNLEEIKKNWMEITDSSLPSPSMGPAPPRWMRSTPRRSTLAEAWNSTGSWTSTGGCALPPAALPSGDLCCRPSLTAGSRGVGVDLTALHQLLHVHYSATGIIPEECSEPTKPFQIILHHDHTEWVQSIGMPIWGTISSSESAIGKNEESQPACAVLSHDS

SEQ ID NO: 27 - protein, 722 aa, Unknown
  RNAseL
AAVEDNHLLIKAVQNEDVDLVQQLLEGGANVNFQEEEGGWTPLHNAVQMSREDIVELLLRHGADPVLRKKNGATPFILAAIAGSVKDLLKLFLSKGADVNECDFYGFTAFMEAAVYGKVKALKFLYKRGANVNLRRKTKEDQERLRKGGATALMDAAEKGHVEVLKILLDEMGADVNACDNMGRNALIHALLSSDDSDVEAITHLLLDHGADVNVRGERGKTPLILAVEKKHLGLVQRLLEQEHIEINDTDSDGKTALLLAVELKLKKIAELLCKRGASTDCGDLVMTARRNYDHSLVKVLLSHGAKEDFHPPAEDWKPQSSHWGAALKDLHRIYRPMIGKLKFFIDEKYKIADTSEGGIYLGFYEKQEVAVKTFCEGSPRAQREVSCLQSSRENSHLVTFYGSESHRGHLFVCVTLCEQTLEACLDVHRGEDVENEEDEFARNVLSSIFKAVQELHLSCGYTHQDLQPQNILIDSKKAAHLADFDKSIKWAGDPQEVKRDLEDLGRLVLYVVKKGSISFEDLKAQSNEEVVQLSPDEETKDLIHRLFHPGEHVRDCLSDLLGHPFFWTWESRYRTLRNVGNESDIKTRKSESEILRLLQPGPSEHSKSFDKWTTKINECVMKKMNKFYEKRGNFYQNTVGDLLKFIRNLGEHIDEEKHKKMKLKIGDPSLYFQKTFPDLVIYVYTKLQNTEYRKHFPQTHSPNKPQCDGAGGASGLASPGC

SEQ ID NO: 28 - protein, 217 aa, Unknown
  RNAseT2
VQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKTKH

SEQ ID NO: 29 - protein, 183 aa, Unknown
  RNAse11
EASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKFVQNPGISCCESLELENTVCQFTTGKQFPRCQYHSVTSLEKILTVLTGHSLMSWLVCGSKL

SEQ ID NO: 30 - protein, 185 aa, Unknown
  RNAseT2-like
  misc_feature (1)..(1): Xaa can be any naturally occurring amino acid
XLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQTTEEDLNLDVEPTTEDTAEEVTIHVLLHSALFGEIGPRRW

SEQ ID NO: 31 - protein, 299 aa, Unknown
  NOB1
APVEHVVADAGAFLRHAALQDIGKNIYTIREVVTEIRDKATRRRLAVLPYELRFKEPLPEYVRLVTEFSKKTGDYPSLSATDIQVLALTYQLEAEFVGVSHLKQEPQKVKVSSSIQHPETPLHISGFHLPYKPKPPQETEKGHSACEPENLEFSSFMFWRNPLPNIDHELQELLIDRGEDVPSEEEEEEENGFEDRKDDSDDDGGGWITPSNIKQIQQELEQCDVPEDVRVGCLTTDFAMQNVLLQMGLHVLAVNGMLIREARSYILRCHGCFKTTSDMSRVFCSHCGNKTLKKVSVTV

SEQ ID NO: 32 - protein, 210 aa, Unknown
  ENDOV
AFSGLQRVGGVDVSFVKGDSVRACASLVVLSFPELEVVYEESRMVSLTAPYVSGFLAFREVPFLLELVQQLREKEPGLMPQVLLVDGNGVLHHRGFGVACHLGVLTDLPCVGVAKKLLQVDGLENNALHKEKIRLLQTRGDSFPLLGDSGTVLGMALRSHDRSTRPLYISVGHRMSLEAAVRLTCCCCRFRIPEPVRQADICSREHIRKS

SEQ ID NO: 33 - protein, 249 aa, Unknown
  ENDOG
AELPPVPGGPRGPGELAKYGLPGLAQLKSRESYVLCYDPRTRGALWVVEQLRPERLRGDGDRRECDFREDDSVHAYHRATNADYRGSGFDRGHLAAAANHRWSQKAMDDTFYLSNVAPQVPHLNQNAWNNLEKYSRSLTRSYQNVYVCTGPLFLPRTEADGKSYVKYQVIGKNHVAVPTHFFKVLILEAAGGQIELRTYVMPNAPVDEAIPLERFLVPIESIERASGLLFVPNILARAGSLKAITAGSK

SEQ ID NO: 34 - protein, 479 aa, Unknown
  ENDOD1
RLVGEEEAGFGECDKFFYAGTPPAGLAADSHVKICQRAEGAERFATLYSTRDRIPVYSAFRAPRPAPGGAEQRWLVEPQIDDPNSNLEEAINEAEAITSVNSLGSKQALNTDYLDSDYQRGQLYPFSLSSDVQVATFTLTNSAPMTQSFQERWYVNLHSLMDRALTPQCGSGEDLYILTGTVPSDYRVKDKVAVPEFVWLAACCAVPGGGWAMGFVKHTRDSDIIEDVMVKDLQKLLPFNPQLFQNNCGETEQDTEKMKKILEVVNQIQDEERMVQSQKSSSPLSSTRSKRSTLLPPEASEGSSSFLGKLMGFIATPFIKLFQLIYYLVVAILKNIVYFLWCVTKQVINGIESCLYRLGSATISYFMAIGEELVSIPWKVLKVVAKVIRALLRILCCLLKAICRVLSIPVRVLVDVATFPVYTMGAIPIVCKDIALGLGGTVSLLFDTAFGTLGGLFQVVFSVCKRIGYKVTFDNSGEL

SEQ ID NO: 35 - protein, 380 aa, Unknown
  hFEN1
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 36 - protein, 186 aa, Homo Sapiens
ESTHVEFKRFTTKKVIPRIKEMLPHYVSAFANTQGGYVLIGVDDKSKEVVGCKWEKVNPDLLKKEIENCIEKLPTFHFCCEKPKVNFTTKILNVYQKDVLDGYVCVIQVEPFCCVVFAEAPDSWIMKDNSVTRLTAEQWVVMMLDTQSAPPSLVTDYNSCLISSASSARKSPGYPIKVHKFKEALQ

SEQ ID NO: 37 - protein, 262 aa, Homo Sapiens
TLQGTNTYLVGTGPRRILIDTGEPAIPEYISCLKQALTEFNTAIQEIVVTHWHRDHSGGIGDICKSINNDTTYCIKKLPRNPQREEIIGNGEQQYVYLKDGDVIKTEGATLRVLYTPGHTDDHMALLLEEENAIFSGDCILGEGTTVFEDLYDYMNSLKELLKIKADIIYPGHGPVIHNAEAKIQQYISHRNIREQQILTLFRENFEKSFTVMELVKIIYKNTPENLHEMAKHNLLLHLKKLEKEGKIFSNTDPDKKWKAHL

SEQ ID NO: 38 - protein, 518 aa, Homo Sapiens
MLRVVSWNINGIRRPLQGVANQEPSNCAAVAVGRILDELDADIVCLQETKVTRDALTEPLAIVEGYNSYFSFSRNRSGYSGVATFCKDNATPVAAEEGLSGLFATQNGDVGCYGNMDEFTQEELRALDSEGRALLTQHKIRTWEGKEKTLTLINVYCPHADPGRPERLVFKMRFYRLLQIRAEALLAAGSHVIILGDLNTAHRPIDHWDAVNLECFEEDPGRKWMDSLLSNLGCQSASHVGPFIDSYRCFQPKQEGAFTCWSAVTGARHLNYGSRLDYVLGDRTLVIDTFQASFLLPEVMGSDHCPVGAVLSVSSVPAKQCPPLCTRFLPEFAGTQLKILRFLVPLEQSPVLEQSTLQHNNQTRVQTCQNKAQVRSTRPQPSQVGSSRGQKNLKSYFQPSPSCPQASPDIELPSLPLMSALMTPKTPEEKAVAKVVKGQAKTSEAKDEKELRTSFWKSVLAGPLRTPLCGGHREPCVMRTVKKPGPNLGRRFYMCARPRGPPTDPSSRCNFFLWSRPS

SEQ ID NO: 39 - protein, 350 aa, Homo Sapiens
MLRVVSWNINGIRRPLQGVANQEPSNCAAVAVGRILDELDADIVCLQETKVTRDALTEPLAIVEGYNSYFSFSRNRSGYSGVATFCKDNATPVAAEEGLSGLFATQNGDVGCYGNMDEFTQEELRALDSEGRALLTQHKIRTWEGKEKTLTLINVYCPHADPGRPERLVFKMRFYRLLQIRAEALLAAGSHVIILGDLNTAHRPIDHWDAVNLECFEEDPGRKWMDSLLSNLGCQSASHVGPFIDSYRCFQPKQEGAFTCWSAVTGARHLNYGSRLDYVLGDRTLVIDTFQASFLLPEVMGSDHCPVGAVLSVSSVPAKQCPPLCTRFLPEFAGTQLKILRFLVPLEQSP

SEQ ID NO: 40 - protein, 123 aa, Homo Sapiens [sequence omitted]

SEQ ID NO: 41 - protein, 136 aa, Homo Sapiens
SSLIRRVISTAKAPGAIGPYSQAVLVDRTIYISGQIGMDPSSGQLVSGGVAEEAKQALKNMGEILKAAGCDFTNVVKTTVLLADINDFNTVNEIYKQYFKSNFPARAAYQVAALPKGSRIEIEAVAIQGPLTTASL

SEQ ID NO: 42 - protein, 189 aa, Homo Sapiens
GGGTPKAPNLEPPLPEEEKEGSDLRPVVIDGSNVAMSHGNKEVFSCRGILLAVNWFLERGHTDITVFVPSWRKEQPRPDVPITDQHILRELEKKKILVFTPSRRVGGKRVVCYDDRFIVKLAYESDGIVVSNDTYRDLQGERQEWKRFIEERLLMYSFVNDKFMPPDDPLGRHGPSLDNFLRKKPLTLE

SEQ ID NO: 43 - protein, 598 aa, Homo Sapiens
SGPCGEKPVLEASPTMSLWEFEDSHSRQGTPRPGQELAAEEASALELQMKVDFFRKLGYSSTEIHSVLQKLGVQADTNTVLGELVKHGTATERERQTSPDPCPQLPLVPRGGGTPKAPNLEPPLPEEEKEGSDLRPVVIDGSNVAMSHGNKEVFSCRGILLAVNWFLERGHTDITVFVPSWRKEQPRPDVPITDQHILRELEKKKILVFTPSRRVGGKRVVCYDDRFIVKLAYESDGIVVSNDTYRDLQGERQEWKRFIEERLLMYSFVNDKFMPPDDPLGRHGPSLDNFLRKKPLTLEHRKQPCPYGRKCTYGIKCRFFHPERPSCPQRSVADELRANALLSPPRAPSKDKNGRRPSPSSQSSSLLTESEQCSLDGKKLGAQASPGSRQEGLTQTYAPSGRSLAPSGGSGSSFGPTDWLPQTLDSLPYVSQDCLDSGIGSLESQMSELWGVRGGGPGEPGPPRAPYTGYSPYGSELPATAAFSAFGRAMGAGHFSVPADYPPAPPAFPPREYWSEPYPLPPPTSVLQEPPVQSPGAGRSPWGRAGSLAKEQASVYTKLCGVFPPHLVEAVMGRFPQLLDPQQLAAEILSYKSQHPSE

SEQ ID NO: 44 - protein, 136 aa, Homo Sapiens; identical to SEQ ID NO: 41

SEQ ID NO: 45 - protein, 966 aa, Ruminococcus flavefaciens
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLAHWVVANNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFANKAVALEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 46 - protein, 1034 aa, Unknown
  Cas13d (contig e-k87 11092736)
MKRQKTFAKRIGIKSTVAYGQGKYAITTFGKGSKAEIAVRSADPPEETLPTESDATLSIHAKFAKAGRDGREFKCGDVDETRIHTSRSEYESLISNPAESPREDYLGLKGTLERKFFGDEYPKDNLRIQIIYSILDIQKILGLYVEDILHFVDGLQDEPEDLVGLGLGDEKMQKLLSKALPYMGFFGSTDVFKVTKKREERAAADEHNAKVFRALGAIRQKLAHFKWKESLAIFGANANMPIRFFQGATGGRQLWNDVIAPLWKKRIERVRKSFLSNSAKNLWVLYQVFKDDTDEKKKARARQYYHFSVLKEGKNLGFNLTKTREYFLDKFFPIFHSSAPDVKRKVDTFRSKFYAILDFIIYEASVSVANSGQMGKVAPWKGAIDNALVKLREAPDEEAKEKIYNVLAASIRNDSLFLRLKSACDKFGAEQNRPVFPNELRNNRDIRNVRSEWLEATQDVDAAAFVQLIAFLCNFLEGKEINELVTALIKKFEGIQALIDLLRNLEGVDSIRFENEFALFNDDKGNMAGRIARQLRLLASVGKMKPDMTDAKRVLYKSALEILGAPPDEVSDEWLAENILLDKSNNDYQKAKKTVNPFRNYIAKNVITSRSFYYLVRYAKPTAVRKLMSNPKIVRYVLKRLPEKQVASYYSAIWTQSESNSNEMVKLIEMIDRLTTEIAGFSFAVLKDKKDSIVSASRESRAVNLEVERLKKLTTLYMSIAYIAVKSLVKVNARYFIAYSALERDLYFFNEKYGEEFRLHFIPYELNGKTCQFEYLAILKYYLARDEETLKRKCEICEEIKVGCEKHKKNANPPYEYDQEWIDKKKALNSERKACERRLHFSTHWAQYATKRDENMAKHPQKWYDILASHYDELLALQATGWLATQARNDAEHLNPVNEFDVYIEDLRRYPEGTPKNKDYHIGSYFEIYHYIRQRAYLEEVLAKRKEYRDSGSFTDEQLDKLQKILDDIRARGSYDKNLLKLEYLPFAYNLPRYKNLTTEALFDDDSVSGKKRVAEWREREKTREAEREQRRQR

SEQ ID NO: 47 - DNA, 30 bp, Unknown
  contig e-k87 11092736
gtgagaagtctccttatggggagatgctac

SEQ ID NO: 48 - protein, 1022 aa, Unknown
  Cas13d (160582958 gene49834)
MKNSVTFKLIQAQENKEAARKKAKDIAEQARIAKRNGVVKKEENRINRIQIEIQTQKKSNTQNAYHLKSLAKAAGVKSVFAIGNDLLMTGFGPGNDATIEKRVFQNRAIETLSSPEQYSAEFQNKQFKIKGNIKVLNHSTQKMEEIQTELQDNYNRPHFDLLGCKNVLEQKYFGRTFSDNIHVQIAYNIMDIEKLLTPYINNIIYTLNELMRDNSKDDFFGCDSHFSVAYLYDELKAGYSDRLKTKPNLSKNIDRIWNNFCNYMNSDSGNTEARLAYFGELFYKPKETGDAKSDYKTHLSNNQKEEWELKSDKEVYNIFAILCDLRHFCTHGESITPSGKPFPYNLEKNLFPEAKQVLNSLFEEKAESLGAEAFGKTAGKTDVSILLKVFEKEQASQKEQQALLKEYYDFKVQKTYKNMGFSIKKLREAIMEIPDAAKFKDDLYSSLRHKLYGLFDFILVKHFLDTSDSENLQNNDIFRQLRACRCEEEKDQVYRSIAVKVWEKVKKKELNMFKQVVVIPSLSKDELKQMEMTKNTELLSSIETISTQASLFSEMIFMMTYLLDGKEINLLCTSLIEKFENIASFNEVLKSPQIGYETKYTEGYAFFKNADKTAKELRQVNNMARMTKPLGGVNTKCVMYNEAAKILGAKPMSKAELESVFNLDNHDYTYSPSGKKIPNKNFRNFIINNVITSRRFLYLIRYGNPEKIRKIAINPSIISFVLKQIPDEQIKRYYPPCIGKRTDDVTLMRDELGKMLQSVNFEQFSRVNNKQNAKQNPNGEKARLQACVRLYLTVPYLFIKNMVNINARYVLAFHCLERDHALCFNSRKLNDDSYNEMANKFQMVRKAKKEQYEKEYKCKKQETGTAHTKKIEKLNQQIAYIDKDIKNMHSYTCRNYRNLVAHLNVVSKLQNYVSELPNDYQITSYFSFYHYCMQLGLMEKVSSKNIPLVESLKNEANDAQSYSAKKTLEYFDLIEKNRTYCKDFLKALNAPFSYNLPRFKNLSIEALFDKNIVYEQADLKKE

SEQ ID NO: 49 - DNA, 36 bp, Unknown
  Cas13d (160582958 gene49834)
gaactacacccctctgttcttgtaggggtctaacac

SEQ ID NO: 50 - protein, 877 aa, Unknown
  Cas13d (contig tpg DJXD01000002.1)
MKKQKSKKTVSKTSGLKEALSVQGTVIMTSFGKGNMANLSYKIPSSQKPQNLNSSAGLKNVEVSGKKIKFQGRHPKIATTDNPLFKPQPGMDLLCLKDKLEMHYFGKTFDDNIHIQLIYQILDIEKILAVHVNNIVFTLDNVLHPQKEELTEDFIGAGGWRINLDYQTLRGQTNKYDRFKNYIKRKELLYFGEAFYHENERRYEEDIFAILTLLSALRQFCFHSDLSSDESDHVNSFWLYQLEDQLSDEFKETLSILWEEVTERIDSEFLKTNTVNLHILCHVFPKESKETIVRAYYEFLIKKSFKNMGFSIKKLREIMLEQSDLKSFKEDKYNSVRAKLYKLFDFIITYYYDHHAFEKEALVSSLRSSLTEENKEEIYIKTARTLASALGADFKKAAADVNAKNIRDYQKKANDYRISFEDIKIGNTGIGYFSELIYMLTLLLDGKEINDLLTTLINKFDNIISFIDILKKLNLEFKFKPEYADFFNMTNCRYTLEELRVINSIARMQKPSADARKIMYRDALRILGMDNRPDEEIDRELERTMPVGADGKFIKGKQGFRNFIASNVIESSRFHYLVRYNNPHKTRTLVKNPNVVKFVLEGIPETQIKRYFDVCKGQEIPPTSDKSAQIDVLARIISSVDYKIFEDVPQSAKINKDDPSRNFSDALKKQRYQAIVSLYLTVMYLITKNLVYVNSRYVIAFHCLERDAFLHGVTLPKMNKKIVYSQLTTHLLTDKNYTTYGHLKNQKGHRKWYVLVKNNLQNSDITAVSSFRNIVAHISVVRNSNEYISGIGELHSYFELYHYLVQSMIAKNNWYDTSHQPKTAEYLNNLKKHHTYCKDFVKAYCIPFGYVVPRYKNLTINELFDRNNPNPEPKEEV

SEQ ID NO: 51 - protein, 36 aa, Homo Sapiens
CAACTACAACCCCGTAAAAATACGGGGTTCTGAAAC

SEQ ID NO: 52-53 - skipped (2 entries)

SEQ ID NO: 54 - protein, 124 aa, Unknown
  CasRX/Cas13d Gut metagenome contig6049000251
LYLTSFGKGNAAVIEQKIEPENGYRVTGMQITPSITVNKATDESVRFRVKRKIAQKDEFIADNPMHEGRHRIEPSAGSDMLGLKTKLEKYYFGKEFDDNLHIQIIYNILDIEKILAVYSTNITA

SEQ ID NO: 55-56 - skipped (2 entries)

SEQ ID NO: 57 - protein, 358 aa, Unknown
  CasRX/Cas13d Gut metagenome contig546000275
MDSYRPKLYKLIDFCIFKHYHEYTEISEKNVDTLRAAVSEEQKESFYADEAKRLWGIFDKQFLGFCKKINVWVNGSHEKEILGYIDKDAYRKKSDVSYFSKFLYAMSFFLDGKEINDLLTTLINKFDNIASFISTAKELDAEIDRILEKKLDPVTGKPLKGKNSFRNFIANNVIENKRFIYVIKFCNPKNVLKLVKNTKVTEFVLKRMPESQIDRYYSSCIDTEKNPSVDKKISDLAEMIKKIAFDDFRNVRQKTRTREESLEKERFKAVIGLYLTVVYLLIKNLVNVNSRYVMAFHCLERDAKLYGINIGKNYIELTEDLCRENENSRSAYLARNKRLRDCVKQNIDNAKNMKSKEK

SEQ ID NO: 58-60 - skipped (3 entries)

SEQ ID NO: 61 - protein, 149 aa, Unknown
  CasRX/Cas13d Gut metagenome contig4114000374
DTKINPQTWLYQLENTPDLDNEYRDTLDHFFDERFNEINEHFVTQNATNLCIMKEVFPDEDFKSIADLYYDFIVVKSYKNIGFSIKKLREKMLELPEAKRVTSTEMDSVRSKLYKLIDFCIFKHYHEKPETVEMIVSMLRAYTSEDMKE

SEQ ID NO: 62-63 - skipped (2 entries)

SEQ ID NO: 64 - protein, 372 aa, Homo Sapiens
MESGQPARRIAMAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLESLRATEKAFGQNSGWLFLDSSTSMFINARARVYHLPDAKMSKKEKISEKMEIKEGEGILWG

SEQ ID NO: 65-66 - skipped (2 entries)

SEQ ID NO: 67 - protein, 320 aa, Unknown
  CasRX/Cas13d Gut metagenome contig721000619
KEGSTMAKNEKKKSTAKALGLKSSFVVNNDIYMTSFGKGNKAVLEKKITENTIENKSDTTYFDVINRDPKGFTLEGRRIADMTAFSNDPKYHVNVVNGKFLEDQLGARSELEKKVFGRTFDDNVHIQLIHNILDIEKIMAQYVSDIVYLLHNTIKRDMNDDIMGYISIRNSFDDFCHPERIPDRKAKDNLQKQHDIFFDEILKCGRLAYFGNAFFEDGSDNKEIAKLKRYKEIYHIIALMGSLRQSYFHGENSDKNFQGPTWAYTLESNLTGKYKEFKDTLDKTFDERYEMISKDFGSTNMVNLQILEELLKMLYGNVSP

SEQ ID NO: 68 - skipped

SEQ ID NO: 69 - protein, 204 aa, Unknown
  CasRX/Cas13d Gut metagenome contig2002000411
EKQNKAKYQAIISLYLMVMYQIVKNMIYVNSRYVIAFHCLERDSNQLLGRFNSRDASMYNKLTQKFITDKYLNDGAQGCSKKVGNYLSHNITCCSDELRKEYRNQVDHFAVVRMIGKYAADIGKFSTWFELYHYVMQRIIFDKRNPLSETERTYKQLIAKHHTYCKDLVKALNTPFGYNLARYKNLSIGELFDRNNYNAKTKET

SEQ ID NO: 70 - skipped

SEQ ID NO: 71 - protein, 449 aa, Unknown
  CasRX/Cas13d Gut metagenome contig13552000311
LIDFLIYDLYYNRKPARIEEIVDKLRESVNDEEKESIYSAETKYVYEALGKVLVRSLKKYLNGATIRDLKNRYDAKTANRIWDISEHSKSGHVNCFCKLIYMMTLMLDGKEINDLLTTLVNKFDNIASFIDVMDELGLEHSFTDNYKMFADSKAICLDLQFINSFARMSKIDDEKSKRQLFRDALVVLDIGDKNEDWIEKYLTSDIFKRDENGNKIDGEKRDFRNFIANNVIKSARFKYLVKYSSADGMIKLKKNEKLISFVLEQLPETQIDRYYESCGLDCAVADRKVRIEKLTGLIRDMRFDNFRGVNYSNDACKKDKQAKAKYQAIISLYLMVLYQIVKNMIYVNSRYVIAFHCLERDLLFFNIELDNSYQYSNCNELTEKFIKDKYMKEGALGFNMKAGRYLTKNIGNCSNELRKIYRNQVDHFAVVRKIGNYAADIASVGSWFE

SEQ ID NO: 72 - protein, 96 aa, Unknown
  CasRX/Cas13d Gut metagenome contig10037000527
YMDQNFANSDAWAIHVYRNKIQHLDAVRHADMYIGDIREFHSWFELYHYIIQRRIIDQYAYESTPGSSRDGSAIIDEERLNPATRRYFRLITTYKT

SEQ ID NO: 73 - protein, 519 aa, Unknown
  CasRX/Cas13d Gut metagenome contig238000329
RYDKDRSKIYTMMDFVIYRYYIDNNNDSIDFINKLRSSIDEKSKEKLYNEEANRLWNKLKEYMLYIKEFNGKLASRTPDRDGNISEFVESLPKIHRLLPRGQKISNFSKLMYLLTMFLDGKEINDLLTTLINKFENIQGFLDIMPEINVNAKFEPEYVFFNKSHEIAGELKLIKGFAQMGEPAATLKLEMTADAIKILGTEKEDAELIKLAESLFKDENGKLLGNKQHGMRNFIGNNVIKSKRFHYLIRYGDPAHLHKIATNKNVVRFVLGRIADMQKKQGQKGKNQIDRYYEVCVGNKDIKKTIEEKIDALTDIIVNMNYDQFEKKKAVIENQNRGKTFEEKNKYKRDNAEREKFKKIISLYLTVIYHILKNIVNVNSRYILGFHCLERDKQLYIEKYNKDKLDGFVALTKFCLGDEERYEDLKAKAQASIQALETANPKLYAKYMNYSDEEKKEEFKKQLNRERVKNARNAYLKNIKNYIMIRLQLRDQTDSSGYLCGEFRDKVAHLEVARHAHEYI

SEQ ID NO: 74 - RNA, 20 nt, Artificial Sequence
  Space Sequence
ggggccggggccggggccgg

SEQ ID NO: 75 - RNA, 20 nt, Artificial Sequence
  Space Sequence
gggccggggccggggccggg

SEQ ID NO: 76 - RNA, 20 nt, Artificial Sequence
  Space Sequence
ggccggggccggggccgggg

SEQ ID NO: 77 - RNA, 20 nt, Artificial Sequence
  Space Sequence
gccggggccggggccggggc

SEQ ID NO: 78 - RNA, 20 nt, Artificial Sequence
  Space Sequence
ccggggccggggccggggcc

SEQ ID NO: 79 - RNA, 20 nt, Artificial Sequence
  Space Sequence
cggggccggggccggggccg

SEQ ID NO: 80 - RNA, 3 nt, Artificial Sequence
  Space Sequence
cag

SEQ ID NO: 81 - RNA, 6 nt, Artificial Sequence
  Space Sequence
ggggcc

SEQ ID NO: 82 - RNA, 93 nt, Artificial Sequence; identical to SEQ ID NO: 13
  Scaffold Sequence

SEQ ID NO: 83 - RNA, 83 nt, Artificial Sequence
  Scaffold Sequence
guuuuagagcuagaaauagcaaguuaaaauaaggcuaguccguuaucaacuugaaaaaguggcaccgagucggugcuuuuuuu

SEQ ID NO: 84 - protein, 181 aa, Unknown
  CasRX/Cas13d Gut metagenome contig2643000492
NGEIVSLAEKEAFSAKIADKNIGCKIENKQFRHPKGYDVIADNPIYKGSPRQDMLGLKETLEKRYFSPSDSIDNVRVQVAHNILDIEKILAEYITNAVYSFDNIAGFGKDIIGDDFSPVYTYDKFEKSDRYEYFKNLLNNSRLGYYGQAFFECDDSKENKKKKDAIKCYNIIALLSGLRHW

SEQ ID NO: 85 - protein, 440 aa, Unknown
  CasRX/Cas13d Gut metagenome contig874000057
MSKNKESYAKGMGLKSALVSGSKVYMTSFEGGNDAKLEKVVENSEIVSLAEKESFSAEIFKKNIGCKIENKKFKHPKRYDVIADNPLYKGSVRQDMLGLKETLEKRYFNSADGTDNVCIQVIHNILDIEKILAEYITNAVYSFDNIAGFGEDIIGMGGFKPIYTYKQFKEPDKYNKKFDDILNNSRLGYYGKAFFEKNDLKHNPNKKKRDKNPYILKYDNECYYIIALLSGLRHWNIHSHAKDDLVSYRWLYNLDSILNREYISTLNYLYDDIADELTESFSKNSSANVNYIAETLNIDPSEFAQQYFRFSIMKEQKNMGFNVSKLREIMLDRKELSDIRDNHRVFDSIRSKLYTMMDFVIYRYYIEEAAKTEAENRNLPENEKKISEKDFFVINLRGSFDENQKEKLYIEEAKRLWEKLKDIMLKIKEFRGEKVKEYKK

SEQ ID NO: 86 - protein, 137 aa, Unknown
  CasRX/Cas13d Gut metagenome contig4781000489
LDKQLDYEYIRTLNYMFNDIADELTRTFSKNSAANVNYIAETLNIDPNKFAEQYFRFSIMKEQKNLGFNLTKLRESMLDRRELSDIRDNHNVFDSIRPKLYTMMDFVIYKHYIDEAKKTEAENKSLPDDRKNLSEKD

SEQ ID NO: 87 - protein, 87 aa, Unknown
  CasRX/Cas13d Gut metagenome contig12144000352
RMGEPVANTKRVMMIDAVKILGTDLSDDELKEMADSFFKDSDGNLLKKGKHGMRNFITNNVIKNKRFHYLIRYGDPAHLHEIAKNEA

SEQ ID NO: 88 - protein, 414 aa, Unknown
  CasRX/Cas13d Gut metagenome contig5590000448
VHNNEEKDLIKYTWLYNLDKYLDAEYITTLNYMYNDIGDELTDSFSKNSAANINYIAETLGIDPKTFAEQYFRFSIMKEQKNLGFNLTKLREVMLDRKDMSEIRENHNDFDSIRAKVYTMMDFVIYRYYIEEAAKVNAANKSLPDNEKSLSEKDIFVISLRGSFNEDQKDRLYYDEAQRLWSKVGKLMLKIKKFRGKDTRKYKNMGTPRIRRLIPEGRDISTFSKLMYALTMFLDGKEINDLLTTLINKFDNIQSFLKVMPLIGVNAKFAEEYSFFNNSEKIADELRLIKSFARMGEPVADARRAMYIDAIRILGTDLSDDELKALADSFSLDENGNKLGKGKHGMRNFIINNVITNKRFHYLIRYGNPVHLHEIAKNEAVVKFVLGRIADIQKKQGQNGKNQIDRYYETCIGK

SEQ ID NO: 89 - protein, 345 aa, Unknown
  CasRX/Cas13d Gut metagenome contig525000349
MSKKENRKSYVKGLGLKSTLVSDSKVYLTTFADGSNAKLEKCVENNKIICISNDKEAFAASIANKNVGYKIKNDEKFRHPKGYDIISNNPLLHNNSVQQDMLGLKNVLEKRYFGKSSGGDNNLCIQIIHNIIDIEKILSEYIPNVVYAFNNIAGFKDEHNNIIDIIGTQTYNSSYTYADFSKDKSDKKYIEFQKLLKNKRLGYWGKAFFTGQGNNAKVRQENQCFHIIALLISLRNWATHSNELDKHTKRTWLYKLDDTNILNAEYVKTLNYLYDTIADELTKSFSKNGAVNVNYLAKKYNIKDDLPGFSEQYFRFSIMKEQKNLGFNISKLRENMLDFKDMSVI

SEQ ID NO: 90 - protein, 206 aa, Unknown
  CasRX/Cas13d Gut metagenome contig7229000302
KKISSLTKFCLGESDEKKLKALAKKSLEELKTTNSKLYENYIKYSDERKAEEAKRQINRERAKTAMNAHLRNTKWNDIMYGQLKDLADSKSRICSEFRNKAAHLEVARYAHMYINDISEVKSYFRLYHYIMQRRIIDVIENNPKAKYEGKVKVYFEDVKKNKKYNKNLLKLMCVPFGYCIPRFKNLSIEQMFDMNETDNSDKKKEK

SEQ ID NO: 91 - protein, 95 aa, Unknown
  CasRX/Cas13d Gut metagenome contig3227000343
IGDISEVNSYFQLYHYIMQRILIDKIGSKTTGKAKEYFDSVIVNKKYDDRLLKLLCSPLGYCLTRYKDLSIEALFDMNEAAKYDKLNKERKNKKK

SEQ ID NO: 92 - protein, 115 aa, Unknown
  CasRX/Cas13d Gut metagenome contig7030000469
SIRSKLYTMMDFVIYRYYIEESAKAAAENKPSESDSFVIRLRGSFNENQKEELYIEEAERLWKKFGEIMLKIKEFRGEKVKEYKKEVPRIERILPHGKDISAFSKLMYMLSMFLD

SEQ ID NO: 93 - protein, 234 aa, Unknown
  CasRX/Cas13d gut metagenome P17E0k2120140920, c87000043
MYFSKMIYMLTYFLDGKEINDLLTTLISKFDNIKEFLKIMKSSAVDVECELTAGYKLFNDSQRITNELFIVKNIASMRKPAASAKLTMFRDALTILGIDDKITDDRISEILKLKEKGKGIHGLRNFITNNVIESSRFVYLIKYANAQKIREVAKNEKVVMFVLGGIPDTQIERYYKSCVEFPDMNSSLEAKRSELARMIKNISFDDFKNVKQQAKGRENVAKERAKAVIGLYLT

SEQ ID NO: 94 - protein, 939 aa, Unknown
  contig emb OBVH01003037.1, human gut metagenome sequence
MAKKKRITAKERKQNHRELLMKKADSNAEKEKAKKPVVENKPDTAISKDNTPKPNKEIKKSKAKLAGVKWVIKANDDVAYISSFGKGNNSVLEKRIMGDVSSNVNKDSHMYVNPKYTKKNYEIKNGFSSGSSLVTYPNKPDKNSGMDALCLKPYFEKDFFGHIFTDNMHIQAIYNIFDIEKILAKHITNIIYTVNSFDRNYNQSGNDTIGFGLNYRVPYSEYGGGKDSNGEPKNQSKWEKRDNFIKFYNESKPHLGYYENIFYDHGEPISEEKFYNYLNILNFIRNNTFHYKDDDIELYSENYSEEFVFINCLNKFVKNKFKNVNKNFISNEKNNLYIILNAYGKDTENVEVVKKYSKELYKLSVLKTNKNLGVNVKKLRESAIEYGYCPLPYDKEKEVAKLSSVKHKLYKTYDFVITHYLNSNDKLLLEIVETLRLSKNDDEKENVYKKYAEKLFKADDVINPIKAISKLFARKGNKLFKEKIIIKKEYIEDVSIDKNIYDFTKVIFFMTCFLDGKEINDLLTNIISKLQVIEDHNNVIKFISNNKDAVYKDYSDKYAIFRNAGKIATELEAIKSIARMENKIENAPQEPLLKDALLSLGVSDDTKVLENTYNKYFDSKEKTDKQSQKVSTFLMNNVINNNRFKYVIKYINPADINGLAKNRYLVKFVLSKIPEEQIDSYYKLFSNEEEPGCEEKIKLLTKKISKLNFQTLFENNKIPNVEKEKKKAIITLYFTIVYILVKNLVNINGLYTLALYFVERDGYFYKDICGKKDKKKSYNDVDYLLLPEIFSGSKYREETKNLKLPKEKDRDIMKKYLPNDKDREKYNKFFTAYRNNIVHLNIIAKLSELTKNIDKDINSYFDIYHYCTQRVMFNYCKEKNDVVLAKMKDLAHIKSDCNEFSSKHTYPFSSAVLRFMNLPFAYNVPRFKNLSYKKFFDKQ

SEQ ID NO: 95 - protein, 877 aa, Unknown; identical to SEQ ID NO: 50
  contig  tpg DJXD01000002.1

SEQ ID NO: 96 - DNA, 36 bp, Unknown
  CasRX/Cas13d DR
caactacaaccccgtaaaaatacggggttctgaaac

SEQ ID NO: 97 - protein, 984 aa, Unknown
  contig OGZC01000639.1
MKKKNIRATREALKAQKIKKSQENEALKKQKLAEEAAQKRREELEKKNLAQWEETSAEGRRSRVKAVGVKSVFVVGDDLYLATFGNGNETVLEKKITPDGKITTFPEEETFTAKLKFAQTEPTVATSIGISNGRIVLPEISVDNPLHTTMQKNTIKRSAGEDILQLKDVLENRYFDRSFNDDLHIRLIYNILDIEKILAEYTTNAVFAIDNVSGCSDDFLSNFSTRNQWDEFQNPEQHREHFGNKDNVICSVKKQQDLFFNFFKNNRIGYFGKAFFHAESERKIVKKTEKEVYHILTLIGSLRQWITHSTEGGISRLWLYQLEDALSREYQETMNNCYNSTIYGLQKDFEKTNAPNLNFLAEILGKNASELAEPYFRFIITKEYKNLGFSIKTLREMLLDQPDLQEIRENHNVYDSIRSKLYKMIDFVLVYAYSNERKSKADALASNLRSAITEDAKKRIYQNEADQLWTSYQELFKRIRGFKGAQVKEYSSKNMPIPIQKQIQNILKPAEQVTYFTKLMYLLTMFLDGKEINDLLTTLINKFDNISSLLKTMEQLELQTTFKEDYTFFQQSSRLCKEITQLKSFARMGNPISNLKEVMMVDAIQILGTEKSEQELQSMACFFFRDKNGKKLNTGEHGMRNFIGNNVISNTRFQYLIRYGNPQKLHTLSQNETVVRFVLSRIAKNQRVQGMNGKNQIDRYYETCGGTNSWSVSEEEKINFLCKILTNMSYDQFQDVKQSGAEITAEEKRKKERYKAIISLYLTVLYQLIKNLVNINARYIIAFHCLERDAILYSSKFNTSINLKKRYTALTEMILGYETDEKARRKDTRTVYEKAEAAKNRHLKNVKWNCKTRENLENADKNAIVAFRNIVAHLWIIRDADRFITGMGAMKRYFDCYHYLLQRELGYILEKSNQGSEYTKKSLEKVQQYHSYCKDFLHMLCLPFAYCIPRYKNLSIAELFDRHEPEAEPKEEASSVNNSQFITT

SEQ ID NO: 98 - protein, 978 aa, Unknown
  contig emb OHBM01000764.1
  misc_feature (1)..(222): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHPLQKRYRYLTSTNLKSFETYKNNLVNKKKFDLDRVKKIPQLAYFGSAFYNTPEDTSAKITKTKIKSNEEIYYTFMLLSTARNFSAHYLDRNRAKSSDAEDFDGTSVIMYNLDNEELYKKLYNKKVHMALTGMKKVLDANFNKKVEHLNNSFIKNSAKDFVILCEVLGIKSRDEKTKFVKDYYDFVVRKNYKHLGFSVKELRELLFANHDSNKYIKEFDKISNKKFDSVRSRLNRLADYIIYDYYNKNNAKVSDLVKYLRAAADDEQKKKIYLNESINLVKSGILERIKKILPKLNGKIIGNMQPDSTITASMLHNTGKDWHPISENAHYFTKWIYTLTLFMDGKEINDLVTTLINKFDNIASFIEVLKSQSVCTHFSEERKMFIDSAEICSELSAMNSFARMEAPGASSKRAMFVEAARILGDNRSKEELEEYFDTLFDKSASKKEKGFRNFIRNNVVDSNRFKYLTRYTDTSSVKAFSNNKALVKFAIKDIPQEQILRYYNSCFGASERYYNDGMSDKLVEAIGKINLMQFNGVIQQADRNMLPEEKKKANAQKEKYKSIIRLYLTVCYLFFKNLVYVNSRYYSAFYNLEKDRSLFEINGELKPTGKFDEGHYTGLVKLFIDNGWINPRASAYLTVNLANSDETAIRTFRNTAEHLEALRNADKYLNDLKQFDSYFEIYHYITQRNIKEKCEMLKEQTVKYNNDLLKYHGYSKDFVKALCVPFGYNLPRFKNLSIDALFDKNDKREKLKKGFED

SEQ ID NO: 99 - protein, 1023 aa, Unknown
  contig emb OHCP01000044.1
MAKKITAKQKREEKERLNKQKWAKNDSVIIVPETKEEIKTGEIQDNNRKRSRQKSQAKAMGLKAVLSFDNKIAIASFVSSKNAKSSHIERITDKEGTTISVNSKMFESSVNKRDINIEKRITIEEPQQDGTIKKEEKGVKSTTCNPYFKVGGKDYIGIKEIAEEHFFGRAFPNENLRVQIAYNIFDVQKILGTFVNNIIYSFYNLSRDEVQSDNDVIGMLYSISDYDRQKETETFLQAKSLLKQTEAYYAYFDDVFKKNKKPDKNKEGDNSKQYQENLRHNFNILRVLSFLRQICMHAEVHVSDDEGCTRTQNYTDSLEALFNISKAFGKKMPELKTLIDNIYSKGINAINDEFVKNGKNNLYILSKVYPNEKREVLLREYYNFVVCKEGSNIGISTRKLKETMIAQNMPSLKEENTYRNKLYTVMNFILVRELKNCATIREQMIKELRANMDEEEGRDRIYSKYAKEIYLYVKDKLKLMLNVFKEEAEGIIIPGKEDPVKFSHGKLDKKEIESFCLTTKNTEDITKVIYFLCKFLDGKEINELCCAMMNKLDGISDLIETAKQCGEDVEFVDQFKCLSKCATMSNQIRIVKNISRMKKEMTIDNDTIFLDALELLGRKIEKYQKDKNGDYVKDEKGKKVYTKDYNNFQDMFFEGKNHRVRNFVSNNVIKSKWFSYVVRYNKPAECQALMRNSKLVKFALDELPDSQIEKYYISVFGEKSSSSNEEMRRELLKKLCDFSVRGFLDEIVLLSEDEMKQKDKFSEKEKKKSLIRLYLTIVYLITKSMVKINTRFSIACATYERDYILLCQSEKAERAWEKGATAFALTRKFLNHDKPTFEQYYTREREISAMPQEKRKELRKENDQLLKKTHYSKHAYCYIVDNVNNLTGAVANDNGRGLPCLSEKNDNANLFLEMRNKIVHLNVVHDMVKYINEIKNITSYYAFFCYVLQRMIIGNNSNEQNKFKAKYSKTLQEFGTYSKDLMWVLNLPFAYNLPRYKNLSNEQLFYDEEERMEKIVGRKNDSR

SEQ ID NO: 100 - protein, 926 aa, Unknown
  contig emb OGDF01008514.1
MTETKPKREDIAKTPAAKSRSKAAGLKSTFAVNGSVLLTSFGRGNDAVPEKLITEKAVSEINTVKPRFSVEKPATSYSSSFGIKSHISATADNPLAGRAPVGEDAIHAKEVLEQRVFGKTFSDDNIHIQLIYNILDIRKILSTYANNVVFTINSMRRLDEYDREQDYLGYLYTGNSYERLLDIADKYAVDGEDWRNTAAGISNDFEKKQFQTINGFWDLLDMIEPYMCYFSEAFFCETTVKDPDSGRIVPCLEQRSDGDIYNILRILSIVRQTCMHDNASMRTVMFTLGQNSVRDRKNGFDELAELLDYLYDEKIDIVNRDFLRNQKNNIELLSRIYGSSADSPERDRLVQNFYDFRVLSQDKNLGFSIKKLREKLLDSPALSVVRSKKYDTMRSKIYSLIDFMIYRKFSENHVAVDDFVEELRSLLTEDEKESAYSRWAETLINDGFAQEILVKLLPQTDPAVIGKIKGKKLLNDSIAGIKLKKDASFFTKIINVLCMFQDGKEINELVSSLVNKFANIQSFVDVMRSQGIDSGFTADYAMFAESGRISRELHILKGIARMQHSIAGLGDVKIYGSDDKFHGVSRRVYTDAAYILGFGERSEDNDGYVDDYVSSKLLGGADKNLRNFITNNVIKNRRFLYTVRYMNPKRAKKLVQNDALVVLALSGIPETQIDRYYKSCIEKRSFNPDLNEKIAALSEMITTLKIDDFEDVKQNPEKNANYEAKKNQRISKERYKACIGLYLTVLYLICKNLVKINARYSIAIGCLERDTQLHGVDFKGAAYMTRDVFIAKGWINPKKPTVKSIKEQYAFLTPYIFTTYRNMIAHLAAVTNAYKYIPQMDRFKSWFHLYHTVIQHSLIQQYEYDRDYGRKGAPVVSERVLQLLEQCREHSNYSRDLLHILNLPFGYNLPRYLNLSSEKYFDANAI

SEQ ID NO: 101 - protein, 1030 aa, Unknown
  contig emb OGPN01002610.1
MAKKITAKQKREEKERLNKQKWAKQDTPVVPKSKTEEKPVAASDDKLLKTTQVKKVQTKSKAKAMGLKTVLSFDDKIAIASFVNDKKTKLPHIERITDKSGTTIHENARMFDSSVDEQNVNIEKRMTIEEKQNDGTFKKDEKDVKATICNPYFKTCGKDYIGIKDVAEKYFFGKTFPNENLRVQIAYNVFDIQKILGTYVNNIIYSFYNLRRDGKSDVDIIGSLYAFADFDNQLKDKPAFREAKDLLKNTEAYFSYFGDVFKKSKKGKKDENNEDYEKNLRHNFNVLRVLSFLRQICTHAYVKCTGGAKNNGDSTKVEAESLDALFNITEYFAKTAPELSKTINEIYKEGIDRINNDFVTNGKNNLYILSKVYPDMQRNELVKKYYQFVVCKEGNNVGINTRKLKESIISQHPWITTPQDNNKANDYESCRHKLYTIMCFILVAELDAHESIRDNMVAELRANMDGDDGRDAIYEKYAKDIYHIVKDKLLAMQKVFDEELVPVKVEGKNDPQQFTHGKLGKKEIESFCLSDKNTSDIAKVVYFLCNFLDGKEINELCCAMMNKFDGIGDLIDTAKQCGEEVKFIEEFACLSNCRKITNDIRVAKSISKMKNKVNIDNDIIYLDAIELLGRKIEKYQKDENGKILLGTDGKRLYTQEYKYFNDMFFNAGNHKVRNFIANNVMQSKWFFYVVRYNKPAECQIIMRNKTLVKFTLDDLPDMQIQRYYSSVFGDNNMPAVDEMRKRLLDKINQFSVRGFLDELDEIVLMSDEESKRNKSSEKEQKKSLIRLYLTIAYLITKSMVKINTRFSIACAMYERDYALLCQSEMKGGPWDGGAQALAVTRKFLNHDREVFDRYCAREAEIARLPSEERKPLRKANDKLLKQTHYTNHSYTYIVNNLNSFTDIDYCAKDVGLPAPNDKNDNASILGEMRNDIAHLNIVHDMVKYIEELKDISSYYAFYCYVLQRRLVGKDPNCQNKFKAKYAKELNDYGTYNKNLMWMLNLPFAYNLPRYKNLSSEFLFYDMEYNKKDDE

SEQ ID NO: 102 - protein, 1027 aa, Unknown
  contig emb OBLI01020244
MAKKITAKQRREERERQNKQKWAKKQADATAVFECEADIKPADSKDEDCTNIYIKREKKKTQAKAMGLKTVLGFDNKIAIASFMSSKDSKSSHIERITDPNGKTIREDVRMFDSNVDECSINLEKRMTVEERQKDGTIKKDEKDVKSTICNPYSNECGKDYIGIKSVAEELFFGRTFPNDNLRVQIAYNIFDIQKILGTYINNIIYSFYNLSRDESQSDNDVIGTLYMLKDFDGQKETDTFRQARALLERTEAYYSYFDNVFKKIDKNKKKSDDCKRERNEILRYNFNVLRVLSFLRQICAHAQVKISNEHDREKGGGLVDSLDALFNISRFFDAVAPELNEVINSVYSKGIDDINDNFVKNGKNNFYILSKIYPEVAREDLLREYYYFVVSKEGNNIGISTKKLKEAIIVQDMSYIKSEDYDTYRNKLYTVLCFILVKELNERTTIREQMVADLRANMNGDIGREDIYSKYAKIIYAQVKPRFDTMKSAFEEEAKDVIVPDKKKPVKFSHGKLDKNEIERFCITSANTDSVAKIIYFLCKFLDGKEINELCCAMMNKLDGINDLIETAEQCGAKVEFVDKFSVLSNCETISDQIRIVKSISKMKKEIAIDNDTIFLDALELLGRKIDKYKKDATGKYLKDENGKYLYSKEYDDFQYMFFKDSHRVRNFISNSVIKSKWFSYIVRYNQPSECRAIMKNKTLVKFALDELPDLQIQRYFVALYGDEDLPSYGEMRKILLKKLHDFSIKGFLDEIVLLSDLDMESQDKYCEKEQKKSLFRLYLTIAYLITKSMVKINTRFSIACATYERDYALLCASNKQERAWSSGATALALTRRFLNQDKLIFEKHYAREGEISKLPKEERKAMRKVNDQLLKRTHFSKHSYCYIVDNVNRLTGGECRTDKRVLPVLNEKNDNAGILLDFRKTIAHLNVVHKMVDYVDEIKGITSYYAFFCYVLQRMLVGNNLNEKNAIKEKYSATVKSFGTYSKDFMWLINLPFAYNLPRYKNLSNEQLFYDEEERNETEEQIDRL

SEQ ID NO: 103 - protein, 961 aa, Unknown
  contig OIZX01000427.1
MAKKKKTARQLREEMQQQRKQAIQKQQEQRQEKAAAARETAAPEQPAAAPVPKRQRKSLAKAAGLKSNFILDPQRRTTVMTAFGQGSTAILEKQIVDRAISDLQPVQQFQVEPASAAKYRLKNSRVRFPNVTADDPLYRRKDGGFVPGMDALRRKNVLEQRFFGKSFADNIHIQMIYSILDIHKILAAASGHIVHLLNIVNGSKDRDFIGMLAAHVLYNELNEEAKRSIADFCKSPRLIYYSAAFYETLDNGKSERRSNEDIFNILALMTCLRNFSSHHSIAIKVKDYSAAGLYNLRRLGPDMKKMLDTFYTEAFIQLNQSFQDHNTTNLTCLFDILNISDSARQKQLAEEFYRYVVFKEQKNLGFSVRKLREEMLLLPDAAVIADKRYDTCRSKLYNLMDFLILRVYRTGRADRCDKLPEALRAALTDEEKAVVYHKEALSLWNEMRTLILDGLLPQMTPENLSRLSGQKRKGELSLDDAMLKECLYEPGPVPEDAAPEEANAEYFCRMIYLATLFMDGKEINTLLTTLISKFENIAAFLQTMEQLNIEAELGPEYAMFTRSRAVAEQLRVINSFALMKKPQVNAKQQLYRAAVTLLGTEDPDGVTDEMLCIDPVTGKMLPPNQRHHGDTGLRNFIANNVVESRRFQYLIRYSDPAQLHQLASNKKLVRFVLSSIPDTQINRYYETCGQTRLAGRAAKVEFLTDMIAAIRFDQFRDVNQKERGANTQKERYKAMLGLYQTVLYLAVKNLVNINARYVMAFHCVERDMFLYDGELTDPKGESVSAFLAVNGKKGVQPQYLLLTQLFIRRDYLKRSACEQIQHNMENISDRLLREYRNAVAHLNVIAHLADYSADMREITSYYGLYHYLMQRHLFKRHAWQIRQPERPTEEEQKLIEQEQKQLAWEKALFDKTLQYHSYNKDLVKALNAPFGYNLARYKNLSIEPLFSKEAAPAAEIKATHA

SEQ ID NO: 104 - protein, 911 aa, Unknown
  contig OCTW011587266.1
MKQNDRENNNKIKKSAAKAVGVKSLARLSDGSTVVSSFGKGAAAELESLITGGEIRKLSDKAILEITDDTQNKNAYNVKSSRIPNLTARTDKLSDKSGMDDLGFKRELELEVFGQCFDDSIHIQIAHAVFDIQKSLAAVIPNVLYTLNNLDRSYSTDNTSDKKDIIGNTLNYQHSYESFNVEKRGEFTEYYNAAKDRFSYFPDILCVLEKVNGKDRYQPKSEKDAFNVLSSVNMLRNSLFHFAPKSNDGKARIAVFKNQFDSDFSHITSTVNKIYSAKIAGVNENFLNNEGNNLYIILKATNWDIKKIVPQLYRFSVLKSDKNMGFNMRKLREFAVESKNIDLSRLNDKFLTNNRKKLYKVIDFIIYYHLNKVLKDSFVDDFVAALRASQSEEEKEKLYAQYSERLFADEGLKSAIKKAVDMISDTKSNIFKMKTPLDKALIENIKVNSDASDFCKLIYVFTRFLDGKEINILLNSLIKKFQDIHSFNTTVKKLSENNLIINADYVDDYSLFEQSGTVARELMLIKSISKMDFGLDNINLSFMYDDALRTLGVSDENLPEVKREYFGKTKNLSAYIRNNVLENRRFKYVIKYIHPSDVQKIACNKAIAGFVLNRMPDTQIKRYYDSLINKGATDIQAQAKALLDCITGISFDAIKDDKHLHKSKEKSPQRSADRERKKAMLTLYYTIVYIFVKQMLHINSLYTIGFFYLERDQRFIYSRAKKENKNPSKNSYLNDFRSVTAYFIPSEIMKRIEKNENKGFLEDFEALWNSCGKTSRLRKEDVLLYARYISPDHALKNYKMILNSYRNKIAHINVIMSAGKYTGGIKRMDSYFSVFQHLVQCDILSNPNNKGKCFESESLKPLLLDMKFDGTDEKLYSKRLTRALNIPFGYNVPRYKNLTFEKIYLKSSINE

SEQ ID NO: 105 - protein, 904 aa, Unknown
  contig emb OGNF01009141.1
MADIDKKKSSAKAAGLKSTFVLENNKLLMTSFGNGNKAVIEKIIDEKVDSINEPEVFSVTPCDKKFELQPAKRGLAADSLVDNPLKSKKTAGDDAIHSRKFLERQFFDGNTFNDNIHIQLIYNILDIEKILSVHVNDIVYSVNNILSRGEGMEYNDYIGTLNLKSFETYKNNLVNKKKFDLDRVKKIPQLAYFGSAFYNTPEDTSAKITKTKIKSNEEIYYTFMLLSTARNFSAHYLDRNRAKSSDAEDFDGTSVIMYNLDNEELYKKLYNKKVHMALTGMKKVLDANFNKKVEHLNNSFIKNSAKDFVILCEVLGIKSRDEKTKFVKDYYDFVVRKNYKHLGFSVKELRELLFANHDSNKYIKEFDKISNKKFDSVRSRLNRLADYIIYDYYNKNNAKVSDLVKYLRAAADDEQKKKIYLNESINLVKSGILERIKKILPKLNGKIIGNMQPDSTITASMLHNTGKDWHPISENAHYFTKWIYTLTLFMDGKEINDLVTTLINKFDNIASFIEVLKSQSVCTHFSEERKMFIDSAEICSELSAMNSFARMEAPGASSKRAMFVEAARILGDNRSKEELEEYFDTLFDKSASKKEKGFRNFIRNNVVDSNRFKYLTRYTDTSSVKAFSNNKALVKFAIKDIPQEQILRYYNSCFGASERYYNDGMSDKLVEAIGKINLMQFNGVIQQADRNMLPEEKKKANAQKEKYKSIIRLYLTVCYLFFKNLVYVNSRYYSAFYNLEKDRSLFEINGELKPTGKFDEGHYTGLVKLFIDNGWINPRASAYLTVNLANSDETAIRTFRNTAEHLEALRNADKYLNDLKQFDSYFEIYHYITQRNIKEKCEMLKEQTVKYNNDLLKYHGYSKDFVKALCVPFGYNLPRFKNLSIDALFDKNDKREKLKKGFED

SEQ ID NO: 106 - protein, 933 aa, Unknown
  contig emb OIEN01002196.1
MERQKRKMKSKSKMAGVKSVFVIGDELLMTSFGDGDDAVLEKDIDENGVVNDCRNPAAYDAVYGTDSIRVKKTNNNIRAKVNNPLAKSNIRSEESALFRTRVNEYKREQKDKYETLFFGKTFDDNIHIQLISKILDIEKTFSVVIGNIVYAINNLSLEQSIDRPIDIFGDKNTQGISLREDNDYLKTMLPRCEYLFHNILNSDSDNNSKMNYNKVNKGKEEKDNRNNENIEKLKKALEVIKIIRVDSFHGVDGIKGDQKFPRSKYNLAVNYNEEIQKTISEPFNRKVEEVQQDFYRNSCVNIDFLKEIMYGSNYTDRGSDSLECSYFNFAILKQNKNMGFSITSIRECLLDLYELNFESMQNLRPRANSFCDFLIYDYYCKNESERANLVDCLRSAASEEEKKNIYFQTAERVKEKFRNAFNRISRFDASYIKNSREKNLSGGSSLPKYSFIEGFTKRSKKINDNDEKNADLFCNMLYYLAQFLDGKEINIFLTSIHNIFQNIDSFLKVMKEKGMECKFQKDFKMFSHAGHVAKKIEIVISLAKMKKTLDFYNAQALKDAVTILGVSKKHQYLDMNSYLDFYMFDNRSGATGKNAGKDHNLRNFLVSNVIRSRKFNYLSRYSNLAEVKKLAQNPSLVQFVLSRIEPSLICRYYESSQGISSEGITIDEQIKKLTGIIVDMNIDSFENINNGEIGMRYSKATPQSIERRNQMRVCVGLYLNVLYQIEKNLMNVNARYVLAFAFAERDALMLNFTLEECKKNKKRSSGGFSFIEMTQFFIDKKLFKVATEAIKKNVLKYNGNPESLNHIPGEYICKNMEGYHENTVRNFRNMVAHLTAVARVPLYISEVTQIDSYYALYHYCMQMNILQGIEQSGKILDNIKLKNALENARVHRTYSKDAVKYLCLPFAYNISRYKALTIKDLFDWTEYSCKKDE

SEQ ID NO: 107 - protein, 1034 aa, Unknown; identical to SEQ ID NO: 46
  contig e-k87 11092736

SEQ ID NO: 108 - DNA, 30 bp, Unknown; identical to SEQ ID NO: 47
  CasRX/Cas13d Direct repeat 1

SEQ ID NO: 109 - protein, 973 aa, Unknown
  CasRX/Cas13d Ga0129306 1000735
MQKQREQQTVTDESERKKKPLKSGAKAAGLKSVFVLSEGKELLTSFGRGNEAVPEKRVTGGTIANARTDNKEAFSAALQNKRFEVFGRTAGSSDDPLAVSRAPGQDLIGAKTALEERYFGRAFADNIHMQVIYAIQDINKILAVHANNIVYTLNNLDREADPETDDFIGSGYLTLKNTFETYCDPAALNEREREKVTVSKQHFDAFMQNPRLAYYGNAFFRKLSKAERLARGREIFDKESPERRQEILGSRGKNKSVDDEIRALAPEWVKREERDVYSELVLMSELRQSCFHGQQKNSARIFRLDNDLGPGVDGARELLDRLYAEKINDLRSFDKTSASSNFRLLFNAYHADNEKKKELAQEFYRFSVLKVSKNTGFSIRTLREKIIEDHAAQYRDKIYDSMRKKLFSTFDFFLWRFYEEREDEAEELRACLRAARSDEEKEQIYAEAAASCWPSVKPFVESVAATLCDVVKGRTKLNKLKLSADESTLVRNAIDGVRISPRASYFTKLIYLMTLFLDGKEINDLLTTLIHAFENIDSFLSVLGSERLERTFDANYRIFADSGVIAQELRAVNSFARMTTEPFNSKLVMFEDAAQLFGMSGGLVEHAEELREYLDNKMLDKTKLRLLPDGKVDTGFRNFIISNVTESRRFRYLVRYCEPRAVRDYMSCRPLIRLTLRDMPDTILRRYYEQSVGAATVDRERILDTLADKLLSLRFTDFENVNQRANAERNREKQKMMGIISLYLNVAYQIVKNLVYVNARYTMAYHCAERDTELLLNAAGEGNLLRRDRSWPARLHLPRRALARRRDRVEVMERDVARGPEAYNRDEWLGLVRTLRREKRVCDNLHNNYAYLCGADAEPGDASLSLLFVYRNKAAHLSVLNKGGRLSGDLKEAKSWFYVYHFLMQRVLEEEFRNTQALPERLRELLMMAERYRGCSKDLIKVLNLTFAYNLPRYKNLSIDGRFDKNHPDPSDE

SEQ ID NO: 110 - protein, 854 aa, Unknown
  CasRX/Cas13d  Ga0129317 1008067
MKKQKKSLVKAAGLKSAFVVGDSVYLTSFGKGNAARLDTKINPDNSTERYVSDSEKHTLKINSITDTELRLSGPFPKQAEAKNPTHKKDNEQKNTRQDMLGLKSTLEKFYFGSTFDDNIHIQIIHNIQDIAKILAAHSNNAGYALDNMLAYQGVEFSDMIGYMGTSRTFDNYDPNHKNNKDFFRFLKLPRLGYFGSAFYSQKGKDFEKRSDEEVYNICALMGQIRQCCFHGKQEKYQLKWLYNFHNFKSNKPFLDTLDKHFDEMIDRINKNFIKNNTPDLIILSGLYPDMAKKELVRLFYDFTTVKEYKNMGFSVKKLREKMLESEEASDFRDKDYDSVRRKLYKLMDFCIYYLYYSDSERNENLVSRLRESLTDENKDIIYSKEAKIVWNELRKKFSTILDNVKGSNIKKLENVKEKFISEDEFDDIKLDIDISYFSKLMYVMCYFLDGKEINDLLTTLVSKFDNIGSIIEAATQIGINIEFIDDFKFFDRSKDISVELNIIRNFARMQAPVPNAKRAMQEDAIRILGGSEEDIFSILDDMTGYDKSGKKLAQSKKGFRNFIINNVVESSRFKYIVRYSNPQKIRKLANNSVVVGFVLGKLPDAQIESYFNSCLPNRVYSTPDKARESLRDMLHNISFNDFADVKQDDRRATPEEKVEKERYKAIIGLYLTVMYHLVKNLVYVNSRYVMAFHCLERDAMHYDVSLDNYRDLIRHLISEGDSSCNHFISHNRRMRDCIEENVKNSEQLIFGKEDAVIRFRNNVAHLSAIRNANEYIGDIREITSYFALYHYLMQRKLIDDCKVNDTAHKYFEQLTKYKTYVMDMVKALCSPFGYNLPRFKNLSIEGKFDMHESK

SEQ ID NO: 111 - protein, 965 aa, Unknown
  CasRX/Cas13d Ga0224415 10048792
MSKKENRKSYVKGLGLKSTLVSDSKVYLTTFADGSNAKLEKCVENNKIICISNDKEAFAASIANKNVGYKIKNDEKFRHPKGYDIISNNPLLHNNSVQQDMLGLKNVLEKRYFGKSSGGDNNLCIQIIHNIIDIEKILSEYIPNVVYAFNNIAGFKDEHNNIIDIIGTQTYNSSYTYADFSKDKSDKKYIEFQKLLKNKRLGYWGKAFFTGQGNNAKVRQENQCFHIIALLISLRNWATHSNELDKHTKRTWLYKLDDTNILNAEYVKTLNYLYDTIADELTKSFSKNGAVNVNYLAKKYNIKDDLPGFSEQYFRFSIMKEQKNLGFNISKLRENMLDFKDMSVIRDDHNRYDKDRSKIYTMMDFVIYRYYIDNNNDSIDFINKLRSSIDEKSKEKLYNEEANRLWNKLKEYMLYIKEFNGKLASRTPDRDGNISEFVESLPKIHRLLPRGQKISNFSKLMYLLTMFLDGKEINDLLTTLINKFENIQGFLDIMPEINVNAKFEPEYVFFNKSHEIAGELKLIKGFAQMGEPAATLKLEMTADAIKILGTEKEDAELIKLAESLFKDENGKLLGNKQHGMRNFIGNNVIKSKRFHYLIRYGDPAHLHKIATNKNVVRFVLGRIADMQKKQGQKGKNQIDRYYEVCVGNKDIKKTIEEKIDALTDIIVNMNYDQFEKKKAVIENQNRGKTFEEKNKYKRDNAEREKFKKIISLYLTVIYHILKNIVNVNSRYILGFHCLERDKQLYIEKYNKDKLDGFVALTKFCLGDEERFEDLKAKAQASIQALETANPKLYAKYMNYSDEEKKEEFKKQLNRERVKNARNAYLKNIKNYIMIRLQLRDQTDSSGYLCGEFRDKVAHLEVARHAHEYIGNIKEVNSYFQLYHYIMQCRLYDVLKNNTKAEAMVKGKAKEYFEALEKEGTYNDKLLKIACVPFGYCIPRYKNLSMEELFDMNEEKKFKKKAPENT

SEQ ID NO: 112 - protein, 1022 aa, Unknown; identical to SEQ ID NO: 48
  CasRX/Cas13d 160582958  gene49834

SEQ ID NO: 113 - protein, 36 aa, Unknown
  CasRX/Cas13d DR
GAACTACACCCCTCTGTTCTTGTAGGGGTCTAACAC

SEQ ID NO: 114 - protein, 998 aa, Unknown
  CasRX/Cas13d 250twins 35838 GL0110300
MGNKQRVSAQKRRENAKLCNQQKARQAESQRDKIKNMNVEKMKNINTNDIKHTKTTAKKLGLKSTIIADKKIILTSFINEQSSKTANIEKVAGFKGDTIDTISYTPRMFRSEINPGEIVISKGDDLSEFANPANFPIGRDYVKIRSALEKQYFGKEFPEDNLHVQIAYNVADIKKILSVYINNIIYMFYNLARSEEYDIFYNSQSENSGRDCDVIGSLYYQASYRNQDANRFEKDGKKKAIDSLLDDTRAYYTYFDGLFSVPKREDDGKIKESEKEKAKDQNFDVLRLLSVGRQLTFHSDKSNNEAYLFDLSKLTRAAQDENRRQDIQSLLNILNSTCRSNLEGVNGDFVKHAKNNLYVLNQLYPSLKANDLIGEYYNFIVKKENRNIGIRLITVRELIIEHNYTNLKDSKYDTYRNKIYTVLNFILFREIQENSIAIKNFREKLRSTEKAEQPALYQAFANKIYPMVQAKFAKAIDLFEEQYKTKFKSEFKGGISIENMQQQNILLQTENIDYFSKYVLFLTKFLDGKEINELLCALINKFDNIADLLDISKQIGTPVVFCADYESLNDAAKIAENIRLIKNIAHLRPAIQEAQSSKDNADAAGTPATLLIDAYNMLNTDIQLVYGEAAYEELRKDLFERKNGTKYNKKGKKVDVYDHKFRNFLINNVIKSKWFFYIAKYVKPADCAKMMSNKKMIEFALRDLPETQIKRYYYTITGNEALGDAESLKGVIIEQLHAFSIKNTLLSIKNMGEGEYKIQQIGSSKEKLKAIVNLYLTVAYLLTKSLVKVNIRFSIAFGCLERDLVLQKKSEKKFDAIINEILLEDDKIRKECDKERAQAKTLPRELAQERFAQIKRRESGCYFKSYHVYDYLSKNSNEFKQNHIDFAVTSYRNNVEHLNVVHCMTKYFSEVKDVKSYYGVYCYIMQRMLCDELIIKNQDKPDVRQTFEEYNRLLKDHGTYSKNLMWLLNFPFAYNLARYKNLSNEDLFNAKNNDQKSK

SEQ ID NO: 115 - protein, 1020 aa, Unknown
  CasRX/Cas13d 250twins 36050 GL0158985
MKKKHQSAAEKRQVKKLKNQEKAQKYASEPSPLQSDTAGVECSQKKTVVSHIASSKTLAKAMGLKSTLVMGDKLVITSFAASKAVGGAGYKSANIEKITDLQGRVIEEHERMFSADVGEKNIELSKNDCHTNVNNPVVTNIGKDYIGLKSRLEQEFFGKTFENDNLHVQLAYNILDIKKILGTYVNNIIYIFYNLNRAGTGRDERMYDDLIGTLYAYKPMEAQQTYLLKGDKDMRRFEEVKQLLQNTSAYYVYYGTLFEKVKAKSKKEQRAKEAEIDACTAHNYDVLRLLSLMRQLCMHSVAGTAFKLAESALFNIEDVLSADLKEILDEAFSGAVNKLNDGFVQHSGNNLYVLQQLYPNETIERIAEKYYRLTVRKEDLNMGVNIKKLRELIVGQYFPEVLDKEYDLSKNGDSVVTYRSKIYTVMNYILLYYLEDHDSSRESMVEALRQNREGDEGKEEIYRQFAKKVWNGVSGLFGVCLNLFKTEKRNKFRSKVALPDVSGAAYMLSSENIDYFVKMLFFVCKFLDGKEINELLCALINKFDNIADILDAAAQCGSSVWFVDSYRFFERSRRISAQIRIVKNIASKDFKKSKKDSDESYPEQLYLDALALLGDVISKYKQNRDGSVVIDDQGNAVLTEQYKRFRYEFFEEIKRDESGGIKYKKSGKPEYNHQRRNFILNNVLKSKWFFYVVKYNRPSSCRELMKNKEILRFVLRDIPDSQVRRYFKAVQGEEAYASAEAMRTRLVDALSQFSVTACLDEVGGMTDKEFASQRAVDSKEKLRAIIRLYLTVAYLITKSMVKVNTRFSIAFSVLERDYYLLIDGKKKSSDYTGEDMLALTRKFVGEDAGLYREWKEKNAEAKDKYFDKAERKKVLRQNDKMIRKMHFTPHSLNYVQKNLESVQSNGLAAVIKEYRNAVAHLNIINRLDEYIGSARADSYYSLYCYCLQMYLSKNFSVGYLINVQKQLEEHHTYMKDLMWLLNIPFAYNLARYKNLSNEKLFYDEEAAAEKADKAENERGE

SEQ ID NO: 116 - protein, 128 aa, Artificial Sequence
  RNase1(K41R)
KESRAKKFQRQHMDSDSSPSSSSTYCNQMMRRRNMTQGRCRPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 117 - protein, 128 aa, Artificial Sequence
  RNase1 (RNase1(K41R, D121E))
KESRAKKFQRQHMDSDSSPSSSSTYCNQMMRRRNMTQGRCRPVNTFVHEPLVDVQNVCFQEKVTCKNGQGNCYKSNSSMHITDCRLTNGSRYPNCAYRTSPKERHIIVACEGSPYVPVHFEASVEDST

SEQ ID NO: 118 - protein, 128 aa, Artificial Sequence
  RNase1 (RNase1(K41R, D121E, H119N))
KESRAKKFQRQHMDSDSSPSSSSTYCNQMMRRRNMTQGRCRPVNTFVHEPLVDVQNVCFQEKVTCKNGQGNCYKSNSSMHITDCRLTNGSRYPNCAYRTSPKERHIIVACEGSPYVPVNFEASVEDST

SEQ ID NO: 119 - protein, 128 aa, Artificial Sequence
  (RNase1(H119N))
KESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVNFDASVEDST

SEQ ID NO: 120 - protein, 128 aa, Artificial Sequence
  (RNase1(R39D, N67D, N88A, G89D, R91D, H119N))
KESRAKKFQRQHMDSDSSPSSSSTYCNQMMRRRNMTQGDCKPVNTFVHEPLVDVQNVCFQEKVTCKDGQGNCYKSNSSMHITDCRLTADSDYPNCAYRTSPKERHIIVACEGSPYVPVNFDASVEDST

SEQ ID NO: 121 - protein, 128 aa, Artificial Sequence
  RNase1 (RNase1(R39D, N67D, N88A, G89D, R91D, H119N, K41R, D121E))
KESRAKKFQRQHMDSDSSPSSSSTYCNQMMRRRNMTQGDCRPVNTFVHEPLVDVQNVCFQEKVTCKDGQGNCYKSNSSMHITDCRLTADSDYPNCAYRTSPKERHIIVACEGSPYVPVNFEASVEDST

SEQ ID NO: 122 - protein, 128 aa, Artificial Sequence
  RNase1 (RNase1(R39D, N67D, N88A, G89D, R91D))
KESRAKKFQRQHMDSDSSPSSSSTYCNQMMRRRNMTQGDCKPVNTFVHEPLVDVQNVCFQEKVTCKDGQGNCYKSNSSMHITDCRLTADSDYPNCAYRTSPKERHIIVACEGSPYVPVHFDASVEDST

SEQ ID NO: 123 - protein, 311 aa, Homo Sapiens
CSPQESGMTALSARMLTRSRSLGPGAGPRGCREEPGPLRRREAAAEARKSHSPVKRPRKAQRLRVAYEGSDSEKGEGAEPLKVPVWEPQDWQQQLVNIRAMRNKKDAPVDHLGTEHCYDSSAPPKVRRYQVLLSLMLSSQTKDQVTAGAMQRLRARGLTVDSILQTDDATLGKLIYPVGFWRSKVKYIKQTSAILQQHYGGDIPASVAELVALPGVGPKMAHLAMAVAWGTVSGIAVDTHVHRIANRLRWTKKATKSPEETRAALEEWLPRELWHEINGLLVGFGQQTCLPVHPRCHACLNQALCPAAQGL

SEQ ID NO: 124 - protein, 372 aa, Homo Sapiens; identical to SEQ ID NO: 64

SEQ ID NO: 125 - protein, 287 aa, Homo Sapiens
PKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLS

SEQ ID NO: 126 - protein, 213 aa, Homo Sapiens
EALFFPSQVTCTEALLRAPGAELAELPEGCPCGLPHGESALSRLLRALLAARASLDLCLFAFSSPQLGRAVQLLHQRGVRVRVVTDCDYMALNGSQIGLLRKAGIQVRHDQDPGYMHHKFAIVDKRVLITGSLNWTTQAIQNNRENVLITEDDEYVRLFLEEFERIWEQFNPTKYTFFPPKKSHGSCAPPVSRAGGRLLSWHRTCGTSSESQT

SEQ ID NO: 127 - protein, 382 aa, Homo Sapiens
KARYKTLEPRGYSLLIRGLIHSDRWREALLLLEDIKKVITPSKKNYNDCIQGALLHQDVNTAWNLYQELLGHDIVPMLETLKAFFDFGKDIKDDNYSNKLLDILSYLRNNQLYPGESFAHSIKTWFESVPGKQWKGQFTTVRKSGQCSGCGKTIESIQLSPEEYECLKGKIMRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 128 - protein, 360 aa, Homo Sapiens
SVEPMFRHLKNTYAGLQLVVVILPGKTPVYAEVKRVGDTVLGMATQCVQMKNVQRTTPQTLSNLCLKINVKLGGVNNILLPQGRPPVFQQPVIFLGADVTHPPAGDGKKPSIAAVVGSMDAHPNRYCATVRVQQHRQEIIQDLAAMVRELLIQFYKSTRFKPTRIIFYRDGVSEGQFQQVLHHELLAIREACIKLEKDYQPGITFIVVQKRHHTRLFCTDKNERVGKSGNIPAGTTVDTKITHPTEFDFYLCSHAGIQGTSRPSHYHVLWDDNRFSSDELQILTYQLCHTYVRCTRSVSIPAPAYYAHLVAFRARYHLVDKEHDSAEGSHTSGQSNGRDHQALAKAVQVHQDTLRTMYFA

SEQ ID NO: 129 - protein, 327 aa, Homo Sapiens
QGAEGALTGKQPDGSAEKAVLEQFGFPLTGTEARCYTNHALSYDQAKRVPRWVLEHISKSKIMGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQVIGEDNVAVPSHLYKVILARRSSVSTEPLALGAFVVPNEAIGFQPQLTEFQVSLQDLEKLSGLVFFPHLDRTSDIRNICSVDTCKLLDFQEFTLYLSTRKIEGARSVLRLEKIMENLKNAEIEPDDYFMSRYEKKLEELKAKEQSGTQIRKPS

SEQ ID NO: 130 - protein, 526 aa, Homo Sapiens
EHPSKMEFFQKLGYDREDVLRVLGKLGEGALVNDVLQELIRTGSRPGALEHPAAPRLVPRGSCGVPDSAQRGPGTALEEDFRTLASSLRPIVIDGSNVAMSHGNKETFSCRGIKLAVDWFRDRGHTYIKVFVPSWRKDPPRADTPIREQHVLAELERQAVLVYTPSRKVHGKRLVCYDDRYIVKVAYEQDGVIVSNDNYRDLQSENPEWKWFIEQRLLMFSFVNDRFMPPDDPLGRHGPSLSNFLSRKPKPPEPSWQHCPYGKKCTYGIKCKFYHPERPHHAQLAVADELRAKTGARPGAGAEEQRPPRAPGGSAGARAAPREPFAHSLPPARGSPDLAALRGSFSRLAFSDDLGPLGPPLPVPACSLTPRLGGPDWVSAGGRVPGPLSLPSPESQFSPGDLPPPPGLQLQPRGEHRPRDLHGDLLSPRRPPDDPWARPPRSDRFPGRSVWAEPAWGDGATGGLSVYATEDDEGDARARARIALYSVFPRDQVDRVMAAFPELSDLARLILLVQRCQSAGAPLGKP

SEQ ID NO: 131 - protein, 475 aa, Homo Sapiens
RQQQPQVVEKQQETPLAPADFAHISQDAQSLHSGASRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARRPCPGATGR

SEQ ID NO: 132 - protein, 384 aa, Homo Sapiens
KLVRKNIEKDNAGQVTLVPEEPEDMWHTYNLVQVGDSLRASTIRKVQTESSTGSVGSNRVRTTLTLCVEAIDFDSQACQLRVKGTNIQENEYVKMGAYHTIELEPNRQFTLAKKQWDSVVLERIEQACDPAWSADVAAVVMQEGLAHICLVTPSMTLTRAKVEVNIPRKRKGNCSQHDRALERFYEQVVQAIQRHIHFDVVKCILVASPGFVREQFCDYLFQQAVKTDNKLLLENRSKFLQVHASSGHKYSLKEALCDPTVASRLSDTKAAGEVKALDDFYKMLQHEPDRAFYGLKQVEKANEAMAIDTLLISDELFRHQDVATRSRYVRLVDSVKENAGTVRIFSSLHVSGEQLSQLTGVAAILRFPVPELSDQEGDSSSEED

SEQ ID NO: 133 - protein, 166 aa, Homo Sapiens
SLVIRNLQRVIPIRRAPLRSKIEIVRRILGVQKFDLGIICVDNKNIQHINRIYRDRNVPTDVLSFPFHEHLKAGEFPQPDFPDDYNLGDIFLGVEYIFHQCKENEDYNDVLTVTATHGLCHLLGFTHGTEAEWQQMFQKEKAVLDELGRRTGTRLQPLTRGLFGGS

SEQ ID NO: 134 - protein, 178 aa, Homo Sapiens
QEVIAGLERFTFAFEKDVEMQKGTGLLPFQGMDKSASAVCNFFTKGLCEKGKLCPFRHDRGEKMVVCKHWLRGLCKKGDHCKFLHQYDLTRMPECYFYSKFGDCSNKECSFLHVKPAFKSQDCPWYDQGFCKDGPLCKYRHVPRIMCLNYLVGFCPEGPKCQFAQKIREFKLLPGSKI

SEQ ID NO: 135 - protein, 384 aa, Homo Sapiens
KLVRKNIEKDNAGQVTLVPEEPEDMWHTYNLVQVGDSLRASTIRKVQTESSTGSVGSNRVRTTLTLCVEAIDFDSQACQLRVKGTNIQENEYVKMGAYHTIELEPNRQFTLAKKQWDSVVLERIEQACDPAWSADVAAVVMQEGLAHICLVTPSMTLTRAKVEVNIPRKRKGNCSQHDRALERFYEQVVQAIQRHIHFDVVKCILVASPGFVREQFCDYMFQQAVKTDNKLLLENRSKFLQVHASSGHKYSLKEALCDPTVASRLSDTKAAGEVKALDDFYKMLQHEPDRAFYGLKQVEKANEAMAIDTLLISDELFRHQDVATRSRYVRLVDSVKENAGTVRIFSSLHVSGEQLSQLTGVAAILRFPVPELSDQEGDSSSEED

SEQ ID NO: 136 - protein, 256 aa, Homo Sapiens
DPAWSADVAAVVMQEGLAHICLVTPSMTLTRAKVEVNIPRKRKGNCSQHDRALERFYEQVVQAIQRHIHFDVVKCILVASPGFVREQFCDYMFQQAVKTDNKLLLENRSKFLQVHASSGHKYSLKEALCDPTVASRLSDTKAAGEVKALDDFYKMLQHEPDRAFYGLKQVEKANEAMAIDTLLISDELFRHQDVATRSRYVRLVDSVKENAGTVRIFSSLHVSGEQLSQLTGVAAILRFPVPELSDQEGDSSSEED

SEQ ID NO: 137 - protein, 209 aa, Homo Sapiens
MDPGKDKEGVPQPSGPPARKKFVIPLDEDEVPPGVRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQK

SEQ ID NO: 138 - protein, 128 aa, Homo Sapiens
KESRAKKFQRQHMDSDSSPSSSSTYCNQMMRRRNMTQGRCKPVNTFVHEPLVDVQNVCFQEKVTCKNGQGNCYKSNSSMHITDCRLTNGSRYPNCAYRTSPKERHIIVACEGSPYVPVHFDASVEDST

SEQ ID NO: 139 - protein, 123 aa, Homo Sapiens [sequence omitted]

SEQ ID NO: 140 - protein, 129 aa, Homo Sapiens
GLGLVQPSYGQDGMYQRFLRQHVHPEETGGSDRYCNLMMQRRKMTLYHCKRFNTFIHEDIWNIRSICSTTNIQCKNGKMNCHEGVVKVTDCRDTGSSRAPNCRYRAIASTRRVVIACEGNPQVPVHFDG

SEQ ID NO: 141 - protein, 375 aa, Homo Sapiens
  misc_feature (1)..(1): Xaa can be any naturally occurring amino acid
XSAVDNILLKLAKFKIGFLRLGQIQKVHPAIQQFTEQEICRSKSIKSLALLEELYNSQLIVATTCMGINHPIFSRKIFDFCIVDEASQISQPICLGPLFFSRRFVLVGDHQQLPPLVLNREARALGMSESLFKRLEQNKSAVVQLTVQYRMNSKIMSLSNKLTYEGKLECGSDKVANAVINLRHFKDVKLELEFYADYSDNPWLMGVFEPNNPVCFLNTDKVPAPEQVEKGGVSNVTEAKLIVFLTSIFVKAGCSPSDIGIIAPYRQQLKIINDLLARSIGMVEVNTVDKYQGRDKSIVLVSFVRSNKDGTVGELLKDWRRLNVAITRAKHKLILLGCVPSLNCYPPLEKLLNHLNSEKLISFFFCIWSHLIALL

SEQ ID NO: 142 - protein, 88 aa, Homo Sapiens
MALRSHDRSTRPLYISVGHRMSLEAAVRLTCCCCRFRIPEPVRQADICSREHIRKSLGLPGPPTPRSPKAQRPVACPKGDSGESSALC

SEQ ID NO: 143 - protein, 212 aa, Homo Sapiens
CYTNHALSYDQAKRVPRWVLEHISKSKIMGDADRKHCKFKPDPNIPPTFSAFNEDYVGSGWSRGHMAPAGNNKFSSKAMAETFYLSNIVPQDFDNNSGYWNRIEMYCRELTERFEDVWVVSGPLTLPQTRGDGKKIVSYQVIGEDNVAVPSHLYKVILARRSSVSTEPLALGAFVVPNEAIGFQPQLTEFQVSLQDLEKLSGLVFFPHLDRT

SEQ ID NO: 144 - protein, 123 aa, Homo Sapiens
VTVSQMTSVLNGKTRRFADIQLQHGALCFNIRYGTTVEEEKNHVLEIARQRAVAQAWTKEQRRLQEGEEGIRAWTEGEKQQLLSTGRVQGYDGYFVLSVEQYLELSDSANNIHFMRQSEIGRR

SEQ ID NO: 145 - protein, 125 aa, Homo Sapiens
TVSQPTLLVNGKTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 146 - skipped

SEQ ID NO: 147 - protein, 1368 aa, Streptococcus pyogenes [sequence omitted]

SEQ ID NO: 148 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 149 - protein, 1368 aa, Streptococcus pyogenes [sequence omitted]

SEQ ID NO: 150 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 151 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINDKGKEVPCNPFLKYKEEHGYIRKYSKKGNGPEIKSLKYYDSKLGNHIDITPKDSNNKVVLQSVSPWRADVYFNKTTGKYEILGLKYADLQFDKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 152 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 153 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 154 - protein, 1084 aa, Corynebacter diphtheria
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDYAREIQEICRMQEIGQELYRKIIDVVFAAESPKGSASSRVGKDPLQPGKNRALKASDAFQRYRIAALIGNLRVRVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLSSQLSVSDIDKASSEALWCALTREPGFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 155 - protein, 1130 aa, Streptococcus pasteurianus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLKNEELFAALRTISKRRGISYLDDAEDDSTGSTDYAKSIDENRRLLKNKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVSTETGKLSTEQKESLVEFAKNTATLGPAKLLKEIAKILDCKVDEIKGYREDDKGKPDLHTFEPYRKLKFNLESINIDDLSREVIDKLADILTLNTEREGIEDAIKRNLPNQFTEEQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNSSDKLPDEVFHGNKQLETKIRLWYQQGERCLYSGKPISIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGKNQVVDKQTGEILSVSDDEYKELVFQPPYQGFVNTISSKGFEDEILFSYQVDSKYNRKVSDATIYSTRKAKIGKDKKEETYVLGKIKDIYSQNGFDTFIKKYNKDKTQFLMYQKDSLTWENVIEVILRDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKKGDKPKLDFKNNKK

SEQ ID NO: 156 - protein, 1082 aa, Neisseria cinerea
MAAFKPNPMNYILGLDIGIASVGWAIVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNTHALQTGDFRTPAELALNKFEKESGHIRNQRGDYSHTFNRKDLQAELNLLFEKQKEFGNPHVSDGLKEGIETLLMTQRPALSGDAVQKMLGHCTFEPTEPKAAKNTYTAERFVWLTKLNNLRILEQGSERPLTDTERATLMDEPYRKSKLTYAQARKLLDLDDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGNRYDEACTEIYGDHYGKKNTEEKIYLPPIPADEIRNPVVLRALSQARKVINGVVRRYGSPARIHIETAREVGKSFKDRKEIEKRQEENRKDREKSAAKFREYFPNFVGEPKSKDILKLRLYEQQHGKCLYSGKEINLGRLNEKGYVEIDHALPFSRTWDDSFNNKVLALGSENQNKGNQTPYEYFNGKDNSREWQEFKARVETSRFPRSKKQRILLQKFDEDGFKERNLNDTRYINRFLCQFVADHMLLTGKGKRRVFASNGQITNLLRGFWGLRKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHKYVTPLFISRAPNRKMSGQGHMETVKSAKRLDEGISVLRVPLTQLKLKDLEKMVNREREPKLYEALKARLEAHKDDPAKAFAEPFYKYDKAGNRTQQVKAVRVEQVQKTGVWVHNHNGIADNATIVRVDVFEKGGKYYLVPIYSWQVAKGILPDRAVVQGKDEEDWTVMDDSFEFKFVLYANDLIKLTAKKNEFLGYFVSLNRATGAIDIRTHDTDSTKGKNGIFQSVGVKTALSFQKYQIDELGKEIRPCRLKKRPPVR

SEQ ID NO: 157 - protein, 1003 aa, Campylobacter lari
MRILGFDIGINSIGWAFVENDELKDCGVRIFTKAENPKNKESLALPRRNARSSRRRLKRRKARLIAIKRILAKELKLNYKDYVAADGELPKAYEGSLASVYELRYKALTQNLETKDLARVILHIAKHRGYMNKNEKKSNDAKKGKILSALKNNALKLENYQSVGEYFYKEFFQKYKKNTKNFIKIRNTKDNYNNCVLSSDLEKELKLILEKQKEFGYNYSEDFINEILKVAFFQRPLKDFSHLVGACTFFEEEKRACKNSYSAWEFVALTKIINEIKSLEKISGEIVPTQTINEVLNLILDKGSITYKKFRSCINLHESISFKSLKYDKENAENAKLIDFRKLVEFKKALGVHSLSRQELDQISTHITLIKDNVKLKTVLEKYNLSNEQINNLLEIEFNDYINLSFKALGMILPLMREGKRYDEACEIANLKPKTVDEKKDFLPAFCDSIFAHELSNPVVNRAISEYRKVLNALLKKYGKVHKIHLELARDVGLSKKAREKIEKEQKENQAVNAWALKECENIGLKASAKNILKLKLWKEQKEICIYSGNKISIEHLKDEKALEVDHIYPYSRSFDDSFINKVLVFTKENQEKLNKTPFEAFGKNIEKWSKIQTLAQNLPYKKKNKILDENFKDKQQEDFISRNLNDTRYIATLIAKYTKEYLNFLLLSENENANLKSGEKGSKIHVQTISGMLTSVLRHTWGFDKKDRNNHLHHALDAIIVAYSTNSIIKAFSDFRKNQELLKARFYAKELTSDNYKHQVKFFEPFKSFREKILSKIDEIFVSKPPRKRARRALHKDTFHSENKIIDKCSYNSKEGLQIALSCGRVRKIGTKYVENDTIVRVDIFKKQNKFYAIPIYAMDFALGILPNKIVITGKDKNNNPKQWQTIDESYEFCFSLYKNDLILLQKKNMQEPEFAYYNDFSISTSSICVEKHDNKFENLTSNQKLLFSNAKEGSVKVESLGIQNLKVFEKYIITPLGDKIKADFQPRENISLKTSKKYGLR

SEQ ID NO: 158 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 159 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 160 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 161 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 162 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 163 - protein, 1629 aa, Francisella novicida
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRADGTKPFIPAFDISKNEIVEAIIDSFTSKNIFWLPKNIELQKVDNKNIFAIDTSKWFEVETPSDLRDIGIATIQYKIDNNSRPKVRVKLDYVIDDDSKINYFMNHSLLKSRYPDKVLEILKQSTIIEFESSGFNKTIKEMLGMKLAGIYNETSNN

SEQ ID NO: 164 - protein, 1371 aa, Lactobacillus buchneri
MKVNNYHIGLDIGTSSIGWVAIGKDGKPLRVKGKTAIGARLFQEGNPAADRRMFRTTRRRLSRRKWRLKLLEEIFDPYITPVDSTFFARLKQSNLSPKDSRKEFKGSMLFPDLTDMQYHKNYPTIYHLRHALMTQDKKFDIRMVYLAIHHIVKYRGNFLNSTPVDSFKASKVDFVDQFKKLNELYAAINPEESFKINLANSEDIGHQFLDPSIRKFDKKKQIPKIVPVMMNDKVTDRLNGKIASEIIHAILGYKAKLDVVLQCTPVDSKPWALKFDDEDIDAKLEKILPEMDENQQSIVAILQNLYSQVTLNQIVPNGMSLSESMIEKYNDHHDHLKLYKKLIDQLADPKKKAVLKKAYSQYVGDDGKVIEQAEFWSSVKKNLDDSELSKQIMDLIDAEKFMPKQRTSQNGVIPHQLHQRELDEIIEHQSKYYPWLVEINPNKHDLHLAKYKIEQLVAFRVPYYVGPMITPKDQAESAETVFSWMERKGTETGQITPWNFDEKVDRKASANRFIKRMTTKDTYLIGEDVLPDESLLYEKFKVLNELNMVRVNGKLLKVADKQAIFQDLFENYKHVSVKKLQNYIKAKTGLPSDPEISGLSDPEHFNNSLGTYNDFKKLFGSKVDEPDLQDDFEKIVEWSTVFEDKKILREKLNEITWLSDQQKDVLESSRYQGWGRLSKKLLTGIVNDQGERIIDKLWNTNKNFMQIQSDDDFAKRIHEANADQMQAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGEPINIDELNKYDIDHILPQAFIKDNSLDNRVLVLTAVNNGKSDNVPLRMFGAKMGHFWKQLAEAGLISKRKLKNLQTDPDTISKYAMHGFIRRQLVETSQVIKLVANILGDKYRNDDTKIIEITARMNHQMRDEFGFIKNREINDYHHAFDAYLTAFLGRYLYHRYIKLRPYFVYGDFKKFREDKVTMRNFNFLHDLTDDTQEKIADAETGEVIWDRENSIQQLKDVYHYKFMLISHEVYTLRGAMFNQTVYPASDAGKRKLIPVKADRPVNVYGGYSGSADAYMAIVRIHNKKGDKYRVVGVPMRALDRLDAAKNVSDADFDRALKDVLAPQLTKTKKSRKTGEITQVIEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVLDGNTKVSSGKREILQEILNGLHANPTFGNLKDVGITTPFGQLQQPNGILLSDETKIRYQSPTGLFERTVSLKDL

SEQ ID NO: 165 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 166 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 167 - protein, 1082 aa, Neisseria lactamica
MAAFKPNPMNYILGLDIGIASVGWAMVEVDEEENPIRLIDLGVRVFERAEVPKTGDSLAMARRLARSVRRLTRRRAHRLLRARRLLKREGVLQDADFDENGLVKSLPNTPWQLRAAALDRKLTCLEWSAVLLHLVKHRGYLSQRKNEGETADKELGALLKGVADNAHALQTGDFRTPAELALNKFEKESGHIRNQRGDYSHTFSRKDLQAELNLLFEKQKEFGNPHVSDGLKEDIETLLMAQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYCKKNAEEKIYLPPIPADEIRNPVVLRALSQARKVINCVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRTENDRHHALDAVVVACSTVAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKGLEKMVNREREPKLYDALKAQLETHKDDPAKAFAEPFYKYDKAGSRTQQVKAVRIEQVQKTGVWVRNHNGIADNATMVRVDVFEKGGKYYLVPIYSWQVAKGILPDRAVVAFKDEEDWTVMDDSFEFRFVLYANDLIKLTAKKNEFLGYFVSLNRATGAIDIRTHDTDSTKGKNGIFQSVGVKTALSFQKNQIDELGKEIRPCRLKKRPPVR

SEQ ID NO: 168 - protein, 1082 aa, Neisseria meningitidis; identical to SEQ ID NO: 152

SEQ ID NO: 169 - protein, 1187 aa, Bifidobacterium longum
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 170 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 171 - protein, 1498 aa, Odoribacter laneus
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 172 - protein, 1300 aa, Francisella tularensis subsp. Novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 173 - protein, 1228 aa, Lachnospiraceae bacterium sp. ND2006
AASKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGAAGYKSLFKKDIIETILPEAADDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNAKTKQALPKFKPLYKQVLSDRESLSFYGEGYTSDEEVLEVFRNTLNKNSEIFSSIKKLEKLFKNFDEYSSAGIFVKNGPAISTISKDIFGEWNLIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFAAAKKNNVFAWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVK

SEQ ID NO: 174 - protein, 1307 aa, Acidaminococcus sp. BV3L6
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 175 - DNA, 28 bp, Leptotrichia shahii
ccaccccaatatcgaaggggactaaaac

SEQ ID NO: 176 - DNA, 36 bp, Leptotrichia wadei
gatttagactaccccaaaaacgaaggggactaaaac

SEQ ID NO: 177 - DNA, 36 bp, Listeria seeligeri
gtaagagactacctctatatgaaagaggactaaaac

SEQ ID NO: 178 - DNA, 35 bp, Lachnospiraceae bacterium MA2020
gtattgagaaaagccagatatagttggcaatagac

SEQ ID NO: 179 - DNA, 35 bp, Lachnospiraceae bacterium NK4A179
gttgatgagaagagcccaagatagagggcaataac

SEQ ID NO: 180 - DNA, 35 bp, Clostridium aminophilum DSM 10710
gtctattgccctctatatcgggctgttctccaaac

SEQ ID NO: 181 - DNA, 36 bp, Carnobacterium gallinarum DSM 4847
attaaagactacctctaaatgtaagaggactataac

SEQ ID NO: 182 - DNA, 36 bp, Carnobacterium gallinarum DSM 4847
aatataaactacctctaaatgtaagaggactataac

SEQ ID NO: 183 - DNA, 36 bp, Paludibacter propionicigenes WB4
cttgtggattatcccaaaattgaagggaactacaac

SEQ ID NO: 184 - DNA, 36 bp, Listeria weihenstephanensis FSL R9-0317
gatttagagtacctcaaaatagaagaggtctaaaac

SEQ ID NO: 185 - DNA, 36 bp, Listeriaceae bacterium FSL M6-0635
gatttagagtacctcaaaacaaaagaggactaaaac

SEQ ID NO: 186 - DNA, 36 bp, Leptotrichia wadei F0279
gatatagataaccccaaaaacgaagggatctaaaac

SEQ ID NO: 187 - DNA, 36 bp, Rhodobacter capsulatus SB 1003
gcctcacatcaccgccaagacgacggcggactgaac

SEQ ID NO: 188 - DNA, 36 bp, Rhodobacter capsulatus R121; identical to SEQ ID NO: 187

SEQ ID NO: 189 - DNA, 36 bp, Rhodobacter capsulatus DE442; identical to SEQ ID NO: 187

SEQ ID NO: 190 - protein, 1389 aa, Unknown
  Cas13a
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 191 - protein, 1221 aa, Bergeyella zoohelcum ATCC 43767
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKEKTYAEYFAEVFKKEKEALIK

SEQ ID NO: 192 - DNA, 21 bp, Artificial Sequence
  GAPDH F primer
cagcctcaagatcatcagcaa

SEQ ID NO: 193 - DNA, 20 bp, Artificial Sequence
  GAPDH R primer
tgtggtcatgagtccttcca

SEQ ID NO: 194 - DNA, 20 bp, Artificial Sequence
  NS5 F primer
gaggagagtgccagagttgt

SEQ ID NO: 195 - DNA, 20 bp, Artificial Sequence
  NS5 R primer
tctctctccccatccagtga

SEQ ID NO: 196 - DNA, 23 bp, Artificial Sequence
  NS5-targeting spacer 1
gcaatgatcttcatgttgggagc

SEQ ID NO: 197 - DNA, 22 bp, Artificial Sequence
  NS5-targeting spacer 2
gaaccttgttgatgaactcttc

SEQ ID NO: 198 - DNA, 22 bp, Artificial Sequence
  NS5-targeting spacer 3
gttggtgattagagcttcattc

SEQ ID NO: 199 - DNA, 23 bp, Artificial Sequence
  NS5-targeting spacer 4
gagtgatcctcgttcaagaatcc

SEQ ID NO: 200 - DNA, 20 bp, Artificial Sequence
  Non-targeting control spacer (lambda2)
gtgataagtggaatgccatg

SEQ ID NO: 201 - DNA, 114 bp, Artificial Sequence
  sgRNA scaffold
  misc_feature (2)..(21): n is a, c, g, t or u
gnnnnnnnnnnnnnnnnnnnnguuuaagagcuaugcuggaaacagcauagcaaguuuaaauaaggcuaguccguuaucaacuugaaaaaguggcaccgagucggugcuuuuuuu

SEQ ID NO: 202 - DNA, 4991 bp, Artificial Sequence
  E43-CjeCas9 and sgRNA plasmid
  misc_feature (297)..(315): n is a, c, g, t or u
gtttattacagggacagcagagatccagtttggttaattaaggtaccgagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnngttttagtccctgaagggactaaaataaagagtttgcgggactctgcggggttacaatcccctaaaaccgctttttttcctgcagcccgggggatccactagttctagagcggccgccaccgcggtggagctccagcttttgttccctttagtgagggttaattgcgcgaattcgctagctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggaccggttctagagcgctatttagaaccatgtgttctccccaagaatctggcatgaccgctctttcagcgaggatgttgacgcgaagcagatccctgggacctggggccgggccacgagggtgtcgggaagaaccaggaccgttgcgacggagggaagcagcagcggaagctcggaaatcccattctccggttaaacgaccccgcaaggcacaacggctcagggttgcttacgaggggagcgattccgaaaagggtgaaggagcagagcccttgaaggttccagtatgggaaccccaggattggcagcagcagcttgtaaacatccgagcaatgaggaacaaaaaagatgcacctgttgatcacctcggaaccgaacattgttatgattctagtgcgccgccaaaagtccgccggtatcaggttctgttgagtttgatgctgagtagtcagactaaggaccaggttacggccggagcaatgcaacggcttcgggcacggggactcacggtcgatagcattttgcagaccgatgacgcaacattgggtaaactcatatatccagttggcttctggcggagcaaagtgaagtacatcaagcagacctcagccattctccaacaacattacggaggtgatatacccgcaagcgtagctgaactggtagcactgccgggcgtcggtcccaaaatggcacatctggctatggcggttgcttggggaacggtgtctggtatcgcagttgatacgcatgtccaccgcatcgccaatcggctgaggtggactaaaaaagccactaagtctcctgaagaaacacgggctgctctggaagagtggcttccacgagagctgtggcatgaaatcaatggattgctggttggtttcgggcagcagacatgcttgcccgtgcacccccggtgtcatgcttgcttgaaccaggctttgtgcccagctgcccagggcctgagtggaagtgagacaccgggaacatctgagtctgcgaccccggagagcacaaacgcgcgaatcctggccttcgcgattggcattagcagcatcggctgggcattctctgaaaacgacgaactgaaggattgcggcgtgcgaattttcactaaggtcgaaaatcccaaaactggtgaatcactcgctctccctagacgactggcacgctccgcacgaaagaggcttgcccgccgcaaggcacgcttgaaccatcttaaacaccttattgcaaatgagtttaaactgaattatgaggactaccaatcctttgacgagtctcttgctaaagcctacaaagggagccttatatccccgtatgagctccggttcagagcactcaacgaactgctgtccaaacaggattttgctcgcgtgattctccacatagcgaagaggcgaggatacgatgacattaaaaacagtgatgataaggaaaaaggggccatactcaaagcgattaagcaaaatgaagagaagctcgctaactatcaatcagtaggggagtatctctataaagagtacttccagaagttcaaagaaaatagcaaggaatttactaatgtccggaataaaaaggagtcttacgaaagatgtattgcgcaatctttcctcaaggacgagctcaaattgattttcaagaaacaaagggaatttgggttcagcttctcaaaaaaatttgaggaagaggttctgagcgttgccttttacaaacgcgcccttaaggacttctcacatctcgtagggaattgtagtttcttcaccgatgaaaaacgggcgccaaaaaatagccctttggcttttatgtttgtcgctctgactcgcatcattaatctgctcaacaaccttaaaaacacggaagggattctgtacacaaaggatgatctgaacgctctgcttaacgaagttttgaagaacgggactttgacctacaaacaaaccaaaaagcttcttggtctcagtgatgactacgaattcaagggagaaaaagggacatatttcatcgaattcaagaagtataaggagttcatcaaagccttgggcgagcacaacttgtctcaagatgatctcaacgaaattgctaaggatatcactctgattaaagacgagatcaagctcaaaaaggcgttggcgaagtatgaccttaaccaaaaccaaatagatagcctcagcaagttggaatttaaagatcacttgaatataagtttcaaggcccttaagttggtcacccccttgatgcttgaaggaaagaaatatgatgaggcatgtaatgagctgaatctcaaggttgctattaacgaagacaaaaaagatttcctcccagctttcaatgagacttactataaggacgaggttaccaatcctgtggtgctccgagccatcaaagagtatcgaaaggtcctgaatgctttgctcaaaaaatacggtaaggtacacaaaataaatattgagctcgcaagggaggtcggtaagaaccactcccagcgcgccaaaatagaaaaggaacagaatgaaaattacaaagcgaaaaaggacgccgagctcgagtgcgaaaagctgggcctgaaaataaacagcaagaacattctcaaactccgcctcttcaaagaacaaaaagaattttgtgcttatagtggtgagaaaataaaaatctccgatcttcaagacgagaagatgctcgaaatagacgcgatatatccatatagcaggtcttttgacgattcttacatgaataaagtgcttgttttcactaagcagaatcaggaaaagttgaatcagaccccctttgaggcctttggcaacgactcagcaaagtggcagaagatcgaggtcttggctaagaatcttcctactaagaaacagaaaaggatattggataagaactataaagacaaagaacaaaagaactttaaagaccgcaacctcaatgacaccagatacatagcaagattggttctgaactacacaaaagattatttggacttcttgccgctgtctgatgatgagaacacgaaactcaacgacacgcaaaaggggtctaaagtccacgtcgaagctaaatctgggatgctcacctcagcattgaggcatacgtggggattctcagcaaaggaccgaaacaatcacctgcaccatgccattgacgcagttatcatagcgtatgccaataattcaatagtaaaagcgtttagcgacttcaagaaggaacaagagtccaacagcgccgagctctacgcaaaaaagattagtgaactcgactacaaaaacaaaagaaaattctttgagccgttcagcggatttcgacagaaggtattggataaaatagatgaaattttcgtgagcaaacccgaaaggaaaaagccctcaggcgccttgcacgaagagactttcaggaaggaagaggaattctaccaaagctacggcggaaaagagggagttttgaaggctctcgaacttggaaagattaggaaggtgaacggcaagatagtgaaaaacggcgatatgttccgggttgatatcttcaaacataaaaaaacgaataaattttatgctgtgcctatatacactatggacttcgcacttaaggtcctgccgaataaggcggtagcccgatctaaaaaaggcgaaattaaggactggattttgatggatgaaaattacgagttctgcttttctctctacaaggattcccttatattgatacagacgaaagatatgcaggaaccggaattcgtgtattacaacgcttttacttcctctacggtatctttgattgtctccaaacatgacaacaaattcgaaacactcagtaaaaaccaaaagattctctttaaaaatgcgaacgagaaagaagtaattgcaaaatcaattggcatccaaaatttgaaagtttttgaaaaatatatagtatctgccctcggagaggttactaaagcggaatttagacagcgagaggacttcaaaaaatcaggtccacccaagaaaaaacgcaaggtggaagatccgaagaaaaagcgaaaagtggatgtgtaacgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccg

SEQ ID NO: 203 - DNA, 5270 bp, Artificial Sequence
  E67-CjeCas9 and sgRNA plasmid
  misc_feature (297)..(315): n is a, c, g, t or u
gtttattacagggacagcagagatccagtttggttaattaaggtaccgagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccnnnnnnnnnnnnnnnnnnngttttagtccctgaagggactaaaataaagagtttgcgggactctgcggggttacaatcccctaaaaccgctttttttcctgcagcccgggggatccactagttctagagcggccgccaccgcggtggagctccagcttttgttccctttagtgagggttaattgcgcgaattcgctagctaggtcttgaaaggagtgggaattggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggaccggttctagagcgctatttagaaccatgcaggaggtaatagcggggcttgagcgatttacctttgccttcgaaaaagacgtagagatgcagaagggaaccggcctgctcccatttcaaggtatggacaaatcagcatctgccgtgtgcaattttttcaccaagggtctgtgtgaaaaggggaagctctgtccatttcgccatgatcgcggagagaagatggtggtgtgtaagcactggctgagagggctttgcaaaaaaggcgaccactgcaaatttcttcaccaatatgacctgactcgaatgcctgagtgttatttttacagtaagttcggtgactgtagcaacaaagaatgcagcttcttgcatgtcaaaccagcattcaagtcacaggattgcccgtggtacgatcagggtttttgcaaggacggtcccctctgcaaatatcgacacgtacccagaattatgtgccttaattacctggtcggcttctgtcctgaagggccaaaatgtcagtttgctcaaaaaattcgcgagttcaaattgctccctgggtctaaaatttgggaaccccaggattggcagcagcagcttgtaaacatccgagcaatgaggaacaaaaaagatgcacctgttgatcacctcggaaccgaacattgttatgattctagtgcgccgccaaaagtccgccggtatcaggttctgttgagtttgatgctgagtagtcagactaaggaccaggttacggccggagcaatgcaacggcttcgggcacggggactcacggtcgatagcattttgcagaccgatgacgcaacattgggtaaactcatatatccagttggcttctggcggagcaaagtgaagtacatcaagcagacctcagccattctccaacaacattacggaggtgatatacccgcaagcgtagctgaactggtagcactgccgggcgtcggtcccaaaatggcacatctggctatggcggttgcttggggaacggtgtctggtatcgcagttgatacgcatgtccaccgcatcgccaatcggctgaggtggactaaaaaagccactaagtctcctgaagaaacacgggctgctctggaagagtggcttccacgagagctgtggcatgaaatcaatggattgctggttggtttcgggcagcagacatgcttgcccgtgcacccccggtgtcatgcttgcttgaaccaggctttgtgcccagctgcccagggcctgagtggaagtgagacaccgggaacatctgagtctgcgaccccggagagcacaaacgcgcgaatcctggccttcgcgattggcattagcagcatcggctgggcattctctgaaaacgacgaactgaaggattgcggcgtgcgaattttcactaaggtcgaaaatcccaaaactggtgaatcactcgctctccctagacgactggcacgctccgcacgaaagaggcttgcccgccgcaaggcacgcttgaaccatcttaaacaccttattgcaaatgagtttaaactgaattatgaggactaccaatcctttgacgagtctcttgctaaagcctacaaagggagccttatatccccgtatgagctccggttcagagcactcaacgaactgctgtccaaacaggattttgctcgcgtgattctccacatagcgaagaggcgaggatacgatgacattaaaaacagtgatgataaggaaaaaggggccatactcaaagcgattaagcaaaatgaagagaagctcgctaactatcaatcagtaggggagtatctctataaagagtacttccagaagttcaaagaaaatagcaaggaatttactaatgtccggaataaaaaggagtcttacgaaagatgtattgcgcaatctttcctcaaggacgagctcaaattgattttcaagaaacaaagggaatttgggttcagcttctcaaaaaaatttgaggaagaggttctgagcgttgccttttacaaacgcgcccttaaggacttctcacatctcgtagggaattgtagtttcttcaccgatgaaaaacgggcgccaaaaaatagccctttggcttttatgtttgtcgctctgactcgcatcattaatctgctcaacaaccttaaaaacacggaagggattctgtacacaaaggatgatctgaacgctctgcttaacgaagttttgaagaacgggactttgacctacaaacaaaccaaaaagcttcttggtctcagtgatgactacgaattcaagggagaaaaagggacatatttcatcgaattcaagaagtataaggagttcatcaaagccttgggcgagcacaacttgtctcaagatgatctcaacgaaattgctaaggatatcactctgattaaagacgagatcaagctcaaaaaggcgttggcgaagtatgaccttaaccaaaaccaaatagatagcctcagcaagttggaatttaaagatcacttgaatataagtttcaaggcccttaagttggtcacccccttgatgcttgaaggaaagaaatatgatgaggcatgtaatgagctgaatctcaaggttgctattaacgaagacaaaaaagatttcctcccagctttcaatgagacttactataaggacgaggttaccaatcctgtggtgctccgagccatcaaagagtatcgaaaggtcctgaatgctttgctcaaaaaatacggtaaggtacacaaaataaatattgagctcgcaagggaggtcggtaagaaccactcccagcgcgccaaaatagaaaaggaacagaatgaaaattacaaagcgaaaaaggacgccgagctcgagtgcgaaaagctgggcctgaaaataaacagcaagaacattctcaaactccgcctcttcaaagaacaaaaagaattttgtgcttatagtggtgagaaaataaaaatctccgatcttcaagacgagaagatgctcgaaatagacgcgatatatccatatagcaggtcttttgacgattcttacatgaataaagtgcttgttttcactaagcagaatcaggaaaagttgaatcagaccccctttgaggcctttggcaacgactcagcaaagtggcagaagatcgaggtcttggctaagaatcttcctactaagaaacagaaaaggatattggataagaactataaagacaaagaacaaaagaactttaaagaccgcaacctcaatgacaccagatacatagcaagattggttctgaactacacaaaagattatttggacttcttgccgctgtctgatgatgagaacacgaaactcaacgacacgcaaaaggggtctaaagtccacgtcgaagctaaatctgggatgctcacctcagcattgaggcatacgtggggattctcagcaaaggaccgaaacaatcacctgcaccatgccattgacgcagttatcatagcgtatgccaataattcaatagtaaaagcgtttagcgacttcaagaaggaacaagagtccaacagcgccgagctctacgcaaaaaagattagtgaactcgactacaaaaacaaaagaaaattctttgagccgttcagcggatttcgacagaaggtattggataaaatagatgaaattttcgtgagcaaacccgaaaggaaaaagccctcaggcgccttgcacgaagagactttcaggaaggaagaggaattctaccaaagctacggcggaaaagagggagttttgaaggctctcgaacttggaaagattaggaaggtgaacggcaagatagtgaaaaacggcgatatgttccgggttgatatcttcaaacataaaaaaacgaataaattttatgctgtgcctatatacactatggacttcgcacttaaggtcctgccgaataaggcggtagcccgatctaaaaaaggcgaaattaaggactggattttgatggatgaaaattacgagttctgcttttctctctacaaggattcccttatattgatacagacgaaagatatgcaggaaccggaattcgtgtattacaacgcttttacttcctctacggtatctttgattgtctccaaacatgacaacaaattcgaaacactcagtaaaaaccaaaagattctctttaaaaatgcgaacgagaaagaagtaattgcaaaatcaattggcatccaaaatttgaaagtttttgaaaaatatatagtatctgccctcggagaggttactaaagcggaatttagacagcgagaggacttcaaaaaatcaggtccacccaagaaaaaacgcaaggtggaagatccgaagaaaaagcgaaaagtggatgtgtaacgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccg

SEQ ID NO: 204 - protein, 137 aa, Unknown
  RNAseK
MGWLRPGPRPLCPPARASWAFSHRFPSPLAPRRSPTPFFMASLLCCGPKLAACGIVLSAWGVIMLIMLGIFFNVHSAVLIEDVPFTEKDFENGPQNIYNLYEQVSYNCFIAAGLYLLLGGFSFCQVRLNKRKEYMVR

SEQ ID NO: 205 - protein, 1245 aa, Unknown
  TALEN
MRIGKSSGWLNESVSLEYEHVSPPTRPRDTRRRPRAAGDGGLAHLHRRLAVGYAEDTPRTEARSPAPRRPLPVAPASAPPAPSLVPEPPMPVSLPAVSSPRFSAGSSAAITDPFPSLPPTPVLYAMARELEALSDATWQPAVPLPAEPPTDARRGNTVFDEASASSPVIASACPQAFASPPRAPRSARARRARTGGDAWPAPTFLSRPSSSRIGRDVFGKLVALGYSREQIRKLKQESLSEIAKYHTTLTGQGFTHADICRISRRRQSLRVVARNYPELAAALPELTRAHIVDIARQRSGDLALQALLPVATALTAAPLRLSASQIATVAQYGERPAIQALYRLRRKLTRAPLHLTPQQVVAIASNTGGKRALEAVCVQLPVLRAAPYRLSTEQVVAIASNKGGKQALEAVKAHLLDLLGAPYVLDTEQVVAIASHNGGKQALEAVKADLLDLRGAPYALSTEQVVAIASHNGGKQALEAVKADLLELRGAPYALSTEQVVAIASHNGGKQALEAVKAHLLDLRGVPYALSTEQVVAIASHNGGKQALEAVKAQLLDLRGAPYALSTAQVVAIASNGGGKQALEGIGEQLLKLRTAPYGLSTEQVVAIASHDGGKQALEAVGAQLVALRAAPYALSTEQVVAIASNKGGKQALEAVKAQLLELRGAPYALSTAQVVAIASHDGGNQALEAVGTQLVALRAAPYALSTEQVVAIASHDGGKQALEAVGAQLVALRAAPYALNTEQVVAIASSHGGKQALEAVRALFPDLRAAPYALSTAQLVAIASNPGGKQALEAVRALFRELRAAPYALSTEQVVAIASNHGGKQALEAVRALFRGLRAAPYGLSTAQVVAIASSNGGKQALEAVWALLPVLRATPYDLNTAQIVAIASHDGGKPALEAVWAKLPVLRGAPYALSTAQVVAIACISGQQALEAIEAHMPTLRQASHSLSPERVAAIACIGGRSAVEAVRQGLPVKAIRRIRREKAPVAGPPPASLGPTPQELVAVLHFFRAHQQPRQAFVDALAAFQATRPALLRLLSSVGVTEIEALGGTIPDATERWQRLLGRLGFRPATGAAAPSPDSLQGFAQSLERTLGSPGMAGQSACSPHRKRPAETAIAPRSIRRSPNNAGQPSEPWPDQLAWLQRRKRTARSHIRADSAASVPANLHLGTRAQFTPDRLRAEPGPIMQAHTSPASVSFGSHVAFEPGLPDPGTPTSADLASFEAEPFGVGPLDFHLDWLLQILET

SEQ ID NO: 206 - protein, 1373 aa, Unknown
  TALEN
MDPIRSRTPSPARELLPGPQPDRVQPTADRGGAPPAGGPLDGLPARRTMSRTRLPSPPAPSPAFSAGSFSDLLRQFDPSLLDTSLLDSMPAVGTPHTAAAPAECDEVQSGLRAADDPPPTVRVAVTAARPPRAKPAPRRRAAQPSDASPAAQVDLRTLGYSQQQQEKIKPKVGSTVAQHHEALVGHGFTHAHIVALSRHPAALGTVAVKYQDMIAALPEATHEDIVGVGKQWSGARALEALLTVAGELRGPPLQLDTGQLVKIAKRGGVTAVEAVHASRNALTGAPLNLTPAQVVAIASNNGGKQALETVQRLLPVLCQAHGLTPAQVVAIASHDGGKQALETMQRLLPVLCQAHGLPPDQVVAIASNIGGKQALETVQRLLPVLCQAHGLTPDQVVAIASHGGGKQALETVQRLLPVLCQAHGLTPDQVVAIASHDGGKQALETVQRLLPVLCQAHGLTPDQVVAIASNGGGKQALETVQRLLPVLCQAHGLTPDQVVAIASNGGKQALETVQRLLPVLCQAHGLTPDQVVAIASHDGGKQALETVQRLLPVLCQTHGLTPAQVVAIASHDGGKQALETVQQLLPVLCQAHGLTPDQVVAIASNIGGKQALATVQRLLPVLCQAHGLTPDQVVAIASNGGGKQALETVQRLLPVLCQAHGLTPDQVVAIASNGGGKQALETVQRLLPVLCQAHGLTQVQVVAIASNIGGKQALETVQRLLPVLCQAHGLTPAQVVAIASHDGGKQALETVQRLLPVLCQAHGLTPDQVVAIASNGGGKQALETVQRLLPVLCQAHGLTQEQVVAIASNNGGKQALETVQRLLPVLCQAHGLTPDQVVAIASNGGGKQALETVQRLLPVLCQAHGLTPAQVVAIASNIGGKQALETVQRLLPVLCQDHGLTLAQVVAIASNIGGKQALETVQRLLPVLCQAHGLTQDQVVAIASNIGGKQALETVQRLLPVLCQDHGLTPDQVVAIASNIGGKQALETVQRLLPVLCQDHGLTLDQVVAIASNGGKQALETVQRLLPVLCQDHGLTPDQVVAIASNSGGKQALETVQRLLPVLCQDHGLTPNQVVAIASNGGKQALESIVAQLSRPDPALAALTNDHLVALACLGGRPAMDAVKKGLPHAPELIRRVNRRIGERTSHRVADYAQVVRVLEFFQCHSHPAYAFDEAMTQFGMSRNGLVQLFRRVGVTELEARGGTLPPASQRWDRILQASGMKRAKPSPTSAQTPDQASLHAFADSLERDLDAPSPMHEGDQTGASSRKRSRSDRAVTGPSAQHSFEVRVPEQRDALHLPLSWRVKRPRTRIGGGLPDPGTPIAADLAASSTVMWEQDAAPFAGAADDFPAFNEEELAWLMELLPQSGSVGGTI

SEQ ID NO: 207 - protein, 1978 aa, Unknown
  ZNF638
MSRPRFNPRGDFPLQRPRAPNPSGMRPPGPFMRPGSMGLPRFYPAGRARGIPHRFAGHESYQNMGPQRMNVQVTQHRTDPRLTKEKLDFHEAQQKKGKPHGSRWDDEPHISASVAVKQSSVTQVTEQSPKVQSRYTKESASSILASFGLSNEDLEELSRYPDEQLTPENMPLILRDIRMRKMGRRLPNLPSQSRNKETLGSEAVSSNVIDYGHASKYGYTEDPLEVRIYDPEIPTDEVENEFQSQQNISASVPNPNVICNSMFPVEDVFRQMDFPGESSNNRSFFSVESGTKMSGLHISGGQSVLEPIKSVNQSINQTVSQTMSQSLIPPSMNQQPFSSELISSVSQQERIPHEPVINSSNVHVGSRGSKKNYQSQADIPIRSPFGIVKASWLPKFSHADAQKMKRLPTPSMMNDYYAASPRIFPHLCSLCNVECSHLKDWIQHQNTSTHIESCRQLRQQYPDWNPEILPSRRNEGNRKENETPRRRSHSPSPRRSRRSSSSHRFRRSRSPMHYMYRPRSRSPRICHRFISRYRSRSRSRSPYRIRNPFRGSPKCFRSVSPERMSRRSVRSSDRKKALEDVVQRSGHGTEFNKQKHLEAADKGHSPAQKPKTSSGTKPSVKPTSATKSDSNLGGHSIRCKSKNLEDDTLSECKQVSDKAVSLQRKLRKEQSLHYGSVLLITELPEDGCTEEDVRKLFQPFGKVNDVLIVPYRKEAYLEMEFKEAITAIMKYIETTPLTIKGKSVKICVPGKKKAQNKEVKKKTLESKKVSASTLKRDADASKAVEIVTSTSAAKTGQAKASVAKVNKSTGKSASSVKSVVTVAVKGNKASIKTAKSGGKKSLEAKKTGNVKNKDSNKPVTIPENSEIKTSIEVKATENCAKEAISDAALEATENEPLNKETEEMCVMLVSNLPNKGYSVEEVYDLAKPFGGLKDILILSSHKKAYIEINRKAAESMVKFYTCFPVLMDGNQLSISMAPENMNIKDEEAIFITLVKENDPEANIDTIYDRFVHLDNLPEDGLQCVLCVGLQFGKVDHHVFISNRNKAILQLDSPESAQSMYSFLKQNPQNIGDHMLTCSLSPKIDLPEVQIEHDPELEKESPGLKNSPIDESEVQTATDSPSVKPNELEEESTPSIQTETLVQQEEPCEEEAEKATCDSDFAVETLELETQGEEVKEEIPLVASASVSIEQFTENAEECALNQQMFNSDLEKKGAEIINPKTALLPSDSVFAEERNLKGILEESPSEAEDFISGITQTMVEAVAEVEKNETVSEILPSTCIVTLVPGIPTGDEKTVDKKNISEKKGNMDEKEEKEFNTKETRMDLQIGTEKAEKNEGRMDAEKVEKMAAMKEKPAENTLFKAYPNKGVGQANKPDETSKTSILAVSDVSSSKPSIKAVIVSSPKAKATVSKTENQKSFPKSVPRDQINAEKKLSAKEFGLLKPTSARSGLAESSSKFKPTQSSLTRGGSGRISALQGKLSKLDYRDITKQSQETEARPSIMKRDDSNNKTLAEQNTKNPKSTTGRSSKSKEEPLFPFNLDEFVTVDEVIEEVNPSQAKQNPLKGKRKETLKNVPFSELNLKKKKGKTSTPRGVEGELSFVTLDEIGEEEDAAAHLAQALVTVDEVIDEEELNMEEMVKNSNSLFTLDELIDQDDCISHSEPKDVTVLSVAEEQDLLKQERLVTVDEIGEVEELPLNESADITFATLNTKGNEGDTVRDSIGFISSQVPEDPSTLVTVDEIQDDSSDLHLVTLDEVTEEDEDSLADFNNLKEELNFVTVDEVGEEEDGDNDLKVELAQSKNDHPTDKKGNRKKRAVDTKKTKLESLSQVGPVNENVMEEDLKTMIERHLTAKTPTKRVRIGKTLPSEKAVVTEPAKGEEAFQMSEVDEESGLKDSEPERKRKKTEDSSSGKSVASDVPEELDFLVPKAGFFCPICSLFYSGEKAMTNHCKSTRHKQNTEKFMAKQRKEKEQNEAEERSSR

SEQ ID NO: 208 - protein, 128 aa, Artificial Sequence; identical to SEQ ID NO: 121
  Rnase1 (R39D, N67D, N88A, G89D, R91D, H119N, K41R, D121E)

SEQ ID NO: 209 - protein, 1091 aa, Unknown
  PUMBY
MDKSKQMNINNLSNIPEVIDPGITIPIYEEEYENNGESNSQLQQQPQKLGSYRSRAGKFSNTLSNLLPSISAKLHHSKKNSHGKNGAEFSSSNNSSQSTVASKTPRASPSRSKMMESSIDGVTMDRPGSLTPPQDMEKLVHFPDSSNNFLIPAPRGSSDSFNLPHQISRTRNNTMSSQITSISSIAPKPRTSSGIWSSNASANDPMQQHLLQQLQPTTSNNTTNSNTLNDYSTKTAYFDNMVSTSGSQMADNKMNTNNLAIPNSVWSNTRQRSQSNASSIYTDAPLYEQPARASISSHYTIPTQESPLIADEIDPQSINWVTMDPTVPSINQISNLLPTNTISISNVFPLQHQQPQLNNAINLTSTSLATLCSKYGEVISARTLRNLNMALVEFSSVESAVKALDSLQGKEVSMIGAPSKISFAKILPMHQQPPQFLLNSQGLPLGLENNNLQPQPLLQEQLFNGAVTFQQQGNVSIPVFNQQSQQSQHQNHSSGSAGFSNVLHGYNNNNSMHGNNNNSANEKEQCPFPLPPPNVNEKEDLLREIIELFEANSDEYQINSLIKKSLNHKGTSDTQNFGPLPEPLSGREFDPPKLRELRKSIDSNAFSDLEIEQLAIAMLDELPELSSDYLGNTIVQKLFEHSSDIIKDIMLRKTSKYLTSMGVHKNGTWACQKMITMAHTPRQIMQVTQGVKDYCTPLINDQFGNYVIQCVLKFGFPWNQFIFESIIANFWVIVQNRYGARAVRACLEAHDIVTPEQSIVLSAMIVTYAEYLSTNSNGALLVTWFLDTSVLPNRHSILAPRLTKRIVELCGHRLASLTILKVLNYRGDDNARKIILDSLFGNVNAHDSSPPKELTKLLCETNYGPTFVHKVLAMPLLEDDLRAHIIKQVRKVLTDSTQIQPSRRLLEEVGLASPSSTHNKTKQQQQQHHNSSISHMFATPDTSGQHMRGLSVSSVKSGGSKHTTMNTTTTNGSSASTLSPGQPLNANSNSSMGYFSYPGVFPVSGFSGNASNGYAMNNDDLSSQFDMLNFNNGTRLSLPQLSLTNHNNTTMELVNNVGSSQPHTNNNNNNNNTNYNDDNTVFETLTLHSAN

SEQ ID NO: 210 - protein, 879 aa, Unknown
  PUF3
MEMNMDMDMDMELASIVSSLSALSHSNNNGGQAAAAGIVNGGAAGSQQIGGFRRSSFTTANEVDSEILLLHGSSESSPIFKKTALSVGTAPPFSTNSKKFFGNGGNYYQYRSTDTASLSSASYNNYHTHHTAANLGKNNKVNHLLGQYSASIAGPVYYNGNDNNNSGGEGFFEKFGKSLIDGTRELESQDRPDAVNTQSQFISKSVSNASLDTQNTFEQNVESDKNFNKLNRNTTNSGSLYHSSSNSGSSASLESENAHYPKRNIWNVANTPVFRPSNNPAAVGATNVALPNQQDGPANNNFPPYMNGFPPNQFHQGPHYQNFPNYLIGSPSNFISQMISVQIPANEDTEDSNGKKKKKANRPSSVSSPSSPPNNSPFPFAYPNPMMFMPPPPLSAPQQQQQQQQQQQQEDQQQQQQQENPYIYYPTPNPIPVKMPKDEKTFKKRNNKNHPANNSNNANKQANPYLENSIPTKNTSKKNASSKSNESTANNHKSHSHSHPHSQSLQQQQQTYHRSPLLEQLRNSSSDKNSNSNMSLKDIFGHSLEFCKDQHGSRFIQRELATSPASEKEVIFNEIRDDAIELSNDVFGNYVIQKFFEFGSKIQKNTLVDQFKGNMKQLSLQMYACRVIQKALEYIDSNQRIELVLELSDSVLQMIKDQNGNHVIQKAIETIPIEKLPFILSSLTGHIYHLSTHSYGCRVIQRLLEFGSSEDQESILNELKDFIPYLIQDQYGNYVIQYVLQQDQFTNKEMVDIKQEIIETVANNVVEYSKHKFASNVVEKSILYGSKNQKDLIISKILPRDKNHALNLEDDSPMILMIKDQFANYVIQKLVNVSEGEGKKLIVIAIRAYLDKLNKSNSLGNRHLASVEKLAALVENAEV

SEQ ID NO: 211 - protein, 888 aa, Unknown
  PUF4
MSTKGLKEEIDDVPSVDPVVSETVNSALEQLQLDDPEENATSNAFANKVSQDSQFANGPPSQMFPHPQMMGGMGFMPYSQMMQVPHNPCPFFPPPDFNDPTAPLSSSPLNAGGPPMLFKNDSLPFQMLSSGAAVATQGGQNLNPLINDNSMKVLPIASADPLWTHSNVPGSASVAIEETTATLQESLPSKGRESNNKASSFRRQTFHALSPTDLINAANNVTLSKDFQSDMQNFSKAKKPSVGANNTAKTRTQSISFDNTPSSTSFIPPTNSVSEKLSDFKIETSKEDLINKTAPAKKESPTTYGAAYPYGGPLLQPNPIMPGHPHNISSPIYGIRSPFPNSYEMGAQFQPFSPILNPTSHSLNANSPIPLTQSPIHLAPVLNPSSNSVAFSDMKNDGGKPTTDNDKAGPNVRMDLINPNLGPSMQPFHILPPQQNTPPPPWLYSTPPPFNAMVPPHLLAQNHMPLMNSANNKHHGRNNNSMSSHNDNDNIGNSNYNNKDTGRSNVGKMKNMKNSYHGYYNNNNNNNNNNNNNNNSNATNSNSAEKQRKIEESSRFADAVLDQYIGSIHSLCKDQHGCRFLQKQLDILGSKAADAIFEETKDYTVELMTDSFGNYLIQKLLEEVTTEQRIVLTKISSPHFVEISLNPHGTRALQKLIECIKTDEEAQIVVDSLRPYTVQLSKDLNGNHVIQKCLQRLKPENFQFIFDAISDSCIDIATHRHGCCVLQRCLDHGTTEQCDNLCDKLLALVDKLTLDPFGNYVVQYIITKEAEKNKYDYTHKIVHLLKPRAIELSIHKFGSNVIEKILKTAIVSEPMILEILNNGGETGIQSLLNDSYGNYVLQTALDISHKQNDYLYKRLSEIVAPLLVGPIRNTPHGKRIIGMLHLDS

SEQ ID NO: 212 - protein, 553 aa, Unknown
  PUF5
MSDSTGRINSKASDSSSISDHQTADLSIFNGSFDGGAFSSSNIPLFNFMGTGNQRFQYSPHPFAKSSDPCRLAALTPSTPKGPLNLTPADFGLADFSVGNESFADFTANNTSFVGNVQSNVRSTRLLPAWAVDNSGNIRDDLTLQDVVSNGSLIDFAMDRTGVKFLERHFPEDHDNEMHFVLFDKLTEQGAVFTSLCRSAAGNFIIQKFVEHATLDEQERLVRKMCDNGLIEMCLDKFACRVVQMSIQKFDVSIAMKLVEKISSLDFLPLCTDQCAIHVLQKVVKLLPISAWSFFVKFLCRDDNLMTVCQDKYGCRLVQQTIDKLSDNPKLHCFNTRLQLLHGLMTSVARNCFRLSSNEFANYVVQYVIKSSGVMEMYRDTIIEKCLLRNILSMSQDKYASHVVEGAFLFAPPLLLSEMMDEIFDGYVKDQETNRDALDILLFHQYGNYVVQQMISICISALLGKEERKMVASEMRLYAKWFDRIKNRVNRHSGRLERFSSGKKIIESLQKLNVPMTMTNEPMPYWAMPTPLMDISAHFMNKLNFQKNSVFDE

SEQ ID NO: 213 - protein, 485 aa, Unknown
  PUF6
MTPNRRSTDSYNMLGASFDFDPDFSLLSNKTHKNKNPKPPVKLLPYRHGSNTTSSDLDNYIFNSGSGSSDDETPPPAAPIFISLEEVLLNGLLIDFAIDPSGVKFLEANYPLDSEDQIRKAVFEKLTESTTLFVGLCHSRNGNFIVQKLVELATPAEQRELLRQMIDGGLLVMCKDKFACRVVQLALQKFDHSNVFQLIQELSTFDLAAMCTDQISIHVIQRVVKQLPVDMWTFFVHFLSSGDSLMAVCQDKYGCRLVQQVIDRLAENPKLPCFKFRIQLLHSLMTCIVRNCYRLSSNEFANYVIQYVIKSSGIMEMYRDTIIDKCLLRNLLSMSQDKYASHVIEGAFLFAPPALLHEMMEEIFSGYVKDVELNRDALDILLFHQYGNYVVQQMISICTAALIGKEERQLPPAILLLYSGWYEKMKQRVLQHASRLERFSSGKKIIDSVMRHGVPTAAAINAQAAPSLMELTAQFDAMFPSFLAR

SEQ ID NO: 214 - protein, 485 aa, Unknown
  PUF7
MTPNRRSTDSYNMLGASFDFDPDFSLLSNKTHKNKNPKPPVKLLPYRHGSNTTSSDSDSYIFNSGSGSSDAETPAPVAPIFISLEDVLLNGQLIDFAIDPSGVKFLEANYPLDSEDQIRKAVFEKFTESTTLFVGLCHSRNGNFIVQKLVELATPAEQRELLRQMIDGGLLAMCKDKFACRVVQLALQKFDHSNVFQLIQELSTFDLAAMCTDQISIHVIQRVVKQLPVDMWTFFVHFLSSGDSLMAVCQDKYGCRLVQQVIDRLAENPKLPCFKFRIQLLHSLMTCIVRNCYRLSSNEFANYVIQYVIKSSGIMEMYRDTIIDKCLLRNLLSMSQDKYASHVIEGAFLFAPPALLHEMMEEIFSGYVKDVESNRDALDILLFHQYGNYVVQQMISICTAALIGKEERELPPAILLLYSGWYEKMKQRVLQHASRLERFSSGKKIIDSVMRHGVPTAAAVNAQAAPSLMELTAQFDAMFPSFLAR

SEQ ID NO: 215 - protein, 535 aa, Unknown
  PUF8
MSRPISIGNTCTFDPSASPIESLGRSIGAQKIVDSVCGSPIRSYGRHISTNPKNERLPDTPEFQFATYMHQGGKVIGQNTLHMFGTPPSCYCAQENIPISSNVGHVLSTINNNYMNHQYNGSNMFSNQMTQMLQAQAYNDLQMHQAHSQSIRVPVQPSATGIFSNPYREPTTTDDLLTRYRANPAMMKNLKLSDIRGALLKFAKDQVGSRFIQQELASSKDRFEKDSIFDEVVSNADELVDDIFGNYVVQKFFEYGEERHWARLVDAIIDRVPEYAFQMYACRVLQKALEKINEPLQIKILSQIRHVIHRCMKDQNGNHVVQKAIEKVSPQYVQFIVDTLLESSNTIYEMSVDPYGCRVVQRCLEHCSPSQTKPVIGQIHKRFDEIANNQYGNYVVQHVIEHGSEEDRMVIVTRVSNNLFEFATHKYSSNVIEKCLEQGAVYHKSMIVGAACHHQEGSVPIVVQMMKDQYANYVVQKMFDQVTSEQRRELILTVRPHIPVLRQFPHGKHILAKLEKYFQKPAVMSYPYQDMQGSH

SEQ ID NO: 216 - protein, 703 aa, Unknown
  PUF9
MADPNWAYAPPTNYYADHSIAKPIMISGGHPSQDQGHSPKSESFGQSVTTAFNGMVDNLVGSPSSSVQQRNYFTTTPFPISRSPNDRNDDKIMGNGSYGVPIPIPQDGVPQGTPDFQMTPFLQQGGHLIGGSPNGPVQVSGNWYSGGAGIFSTMQQADPSNGMPGMAAEFVNNENGMPGPNGMHQQAMISGSPPFPYQNMMNLTTSFGAMGLGPQQIQQRDPQMFQQPILHEPIQGMAQNGFGQQVFFTQMQNQQHPQGQAQQQLQQLAQQHQQQQNSQQFFGQGPNGMGNGGVMNDWSQRSFGMPQQQAQQNGLPPNFSQNPPRRRGPEDPNGQTPKTLQDIKNNVIEFAKDQHGSRFIQQKLERASLRDKAAIFTPVLENAEELMTDVFGNYVIQKFFEFGNNEQRNQLVGTIRGNVMKLALQMYGCRVIQKALEYVEEKYQHEILGEMEGQVLKCVKDQNGNHVIQKVIERVEPERLQFIIDAFTKNNSDNVYTLSVHPYGCRVIQRVLEYCNEEQKQPVLDALQIHLKQLVLDQYGNYVIQHVIEHGSPSDKEQIVQDVISDDLLKFAQHKFASNVIEKCLTFGGHAERNLIIDKVCGDPNDPSPPLLQMMKDPFANYVVQKMLDVADPQHRKKITLTIKPHIATLRKYNFGKHILLKLEKYFAKQAPANSSNSSSNDQIYEHSPFDIPLGADFSNHPF

We claim:

1. A composition comprising a nucleic acid encoding a fusion protein, the fusion protein comprising a first RNA-binding polypeptide and a second RNA-binding polypeptide, wherein the first RNA-binding polypeptide is a *Pumilio* and FBF Homology Family (PUF) polypeptide, *Pumilio*-based assembly (PUMBY) peptide, or RNA-binding domain thereof, wherein the second RNA-binding polypeptide comprises RNA-nuclease activity, wherein the second RNA-binding polypeptide comprises a Zinc Finger CCCH-Type Containing 12A (ZC3H12A) polypeptide, and wherein the ZC3H12A polypeptide comprises SEQ ID NO: 42.

2. The composition of claim 1, wherein the ZC3H12A polypeptide comprises SEQ ID NO: 43.

3. The composition of claim 1, wherein the ZC3H12A polypeptide is capable of binding RNA.

4. The composition of claim 3, wherein the ZC3H12A polypeptide is capable of binding and cleaving RNA.

5. The composition of claim 1, wherein the nucleic acid comprises a promoter.

6. The composition of claim 5, wherein the promoter is a constitutive promoter or a tissue-specific promoter.

7. The composition of claim 1, wherein the fusion protein comprises a nuclear localization signal (NLS), a nuclear export signal (NES) or tag.

8. A vector comprising the composition of claim 1.

9. The vector of claim 8, wherein the vector is selected from the group consisting of: adeno-associated virus, retrovirus, lentivirus, and adenovirus.

10. An in vitro cell comprising the vector of claim 8.

11. The vector of claim 8, wherein the vector is selected from the group consisting of: nanoparticle, micelle, liposome, lipoplex, polymersome, polyplex, and dendrimer.

* * * * *